(12) United States Patent
Benz et al.

(10) Patent No.: US 12,110,335 B2
(45) Date of Patent: Oct. 8, 2024

(54) BISPECIFIC ANTI-VEGF AND ANTI-TrkB BINDING MOLECULES FOR THE TREATMENT OF EYE DISEASES

(71) Applicant: Boehringer Ingelheim International GmbH, Ingelheim am Rhein (DE)

(72) Inventors: Peter Michael Benz, Veitshoechheim (DE); Remko Alexander Bakker, Biberach an der Riss (DE); Holger Fuchs, Warthausen (DE); Fei Han, Acton, MA (US); Sandeep Kumar, Ridgefield, CT (US); Sarah Low, Carmel, NY (US); Justin M. Scheer, Ridgefield, CT (US); Leo Thomas, Biberach an der Riss (DE)

(73) Assignee: Boehringer Ingelheim International GmbH, Ingelheim am Rhein (DE)

(*) Notice: Subject to any disclaimer, the term of this patent is extended or adjusted under 35 U.S.C. 154(b) by 0 days.

(21) Appl. No.: 17/505,672

(22) Filed: Oct. 20, 2021

(65) Prior Publication Data

US 2022/0119535 A1    Apr. 21, 2022

(30) Foreign Application Priority Data

Oct. 21, 2020   (EP) .................... 20203030

(51) Int. Cl.
| | | |
|---|---|---|
| *C07K 16/28* | (2006.01) | |
| *A61K 39/00* | (2006.01) | |
| *A61P 27/02* | (2006.01) | |
| *C07K 16/22* | (2006.01) | |

(52) U.S. Cl.
CPC .......... *C07K 16/2863* (2013.01); *A61P 27/02* (2018.01); *C07K 16/22* (2013.01); *A61K 2039/505* (2013.01); *C07K 2317/14* (2013.01); *C07K 2317/31* (2013.01); *C07K 2317/35* (2013.01); *C07K 2317/53* (2013.01); *C07K 2317/54* (2013.01); *C07K 2317/55* (2013.01); *C07K 2317/565* (2013.01); *C07K 2317/622* (2013.01); *C07K 2317/73* (2013.01); *C07K 2317/75* (2013.01); *C07K 2317/76* (2013.01); *C07K 2317/92* (2013.01)

(58) Field of Classification Search
CPC .............................................. C07K 16/2863
See application file for complete search history.

(56) References Cited

U.S. PATENT DOCUMENTS

| | | | |
|---|---|---|---|
| 4,676,980 | A | 6/1987 | Segal et al. |
| 5,731,168 | A | 3/1998 | Carter et al. |
| 9,650,443 | B2 | 5/2017 | Song et al. |
| 10,793,634 | B2 | 10/2020 | Herrmann et al. |
| 2008/0050370 | A1* | 2/2008 | Glaser ............... 424/133.1 |
| 2010/0196390 | A1* | 8/2010 | Lin et al. .......... 424/146.1 |
| 2020/0399378 | A1 | 12/2020 | Herrmann et al. |
| 2022/0119535 | A1 | 4/2022 | Benz et al. |
| 2022/0185875 | A1 | 6/2022 | Ying et al. |

FOREIGN PATENT DOCUMENTS

| | | |
|---|---|---|
| EP | 0307434 A1 | 3/1989 |
| EP | 4095161 A1 | 11/2022 |
| JP | 2018531005 A | 10/2018 |
| JP | 2019531762 A | 11/2019 |
| JP | 6636684 B2 | 1/2020 |
| JP | 2020513806 A | 5/2020 |
| JP | 2020514376 A | 5/2020 |
| JP | 2020187202 A1 | 9/2020 |
| WO | 8801649 A1 | 3/1988 |
| WO | 9005144 A1 | 5/1990 |
| WO | 9117271 A1 | 11/1991 |
| WO | 9308829 A1 | 5/1993 |
| WO | 9404678 A1 | 3/1994 |
| WO | 9413804 A1 | 6/1994 |
| WO | 9429348 A2 | 12/1994 |
| WO | 9825971 A1 | 6/1998 |
| WO | 0179258 A1 | 10/2001 |
| WO | 02056910 A1 | 7/2002 |
| WO | 03050531 A2 | 6/2003 |
| WO | 2004003019 A2 | 1/2004 |
| WO | 2004041865 A2 | 5/2004 |
| WO | 2004081026 A2 | 9/2004 |
| WO | 2007042309 A2 | 4/2007 |
| WO | 2009089004 A1 | 7/2009 |
| WO | WO-2010040508 A1 * | 4/2010 ........... A61K 39/395 |
| WO | 2010086828 A2 | 8/2010 |
| WO | 2012061558 A2 | 5/2012 |
| WO | 2017053807 A2 | 3/2017 |

(Continued)

OTHER PUBLICATIONS

Chong ZX, et al., Transfection types, methods and strategies: a technical review. PeerJ. Apr. 21, 2021;9:e11165. doi: 10.7717/peerj.11165. PMID: 33976969; PMCID: PMC8067914. (Year: 2021).*
Ranibizumab, MedlinePLus, retrieved from: https://medlineplus.gov/druginfo/meds/a607044.html (Year: 2022).*
Everything you always wanted to know about antibody humanisation, GTO Bioways CDMO, retrieved from: https://www.gtp-bioways.com/protein-engineering/everything-you-always-wanted-to-know-about-antibody-humanisation/ (Year: 2018).*
McCarthy et al. (J. Immunol. Methods, 251(1-2): 137-149, 2001) (Year: 2001).*
Lin et al. (African Journal of Biotechnology, 10(79):18294-18302, 2011) (Year: 2011).*

(Continued)

*Primary Examiner* — Elizabeth C. Kemmerer
*Assistant Examiner* — Ashley H. Gao
(74) *Attorney, Agent, or Firm* — Mary Breen Smith

(57) ABSTRACT

This invention relates to binding molecules that bind specifically Vascular Endothelial Growth Factor (VEGF) and Tropomyosin receptor kinase B (TrkB) and their use in medicine, pharmaceutical compositions comprising the same, and methods of using the same as agents for treatment and/or prevention of diseases of the eye.

15 Claims, 69 Drawing Sheets

Specification includes a Sequence Listing.

(56) References Cited

FOREIGN PATENT DOCUMENTS

| WO | 2017192538 A1 | 11/2017 | |
|---|---|---|---|
| WO | 2018046997 A2 | 3/2018 | |
| WO | 2018166495 A1 | 9/2018 | |
| WO | 2018175752 A1 | 9/2018 | |
| WO | WO-2018224630 A1 * | 12/2018 | ............... A61P 25/28 |

OTHER PUBLICATIONS

Hayden, Gene Synthesis by serial cloning of oligonucleotides, DNA, 1988.
Frank, High-performance liquid chromatographic assay for the experimental anticancer agent oxantrazole, J. of Chromatography, 1987.
Ye, Gene synthesis and expression, Biochem and Biophysical Research, vol. 186, 1992.
Kipriyanov, Recent advances in the generation of bispecific antibodies, Curr. Opinion Drug Discov Devel., 2004.
Bakri, Pharmacokinetics of intravitreal Avastin, Ophthalmology, 2007.
Park, The making of bispecific antibodies, IOVS, 2016.
Hsu, Detection of aqueous VEGF concentrations befor and after intravitreal injection of anti-VEGF antibody, Sci. Rep., 2016.
Sato, Intraocular inflammatory cytokines, Sci. Rep, 2018.
Hata, Intraocular Vascular Endothelial growth factor levels in Pachychoroid Neovasculopathy, IOVS, 2017.
Cabral, Aqueous vascular endothelial growth factor and clinical outcomes, Int. J. Retin. Vitr., 2017.
Hutton, A mechanisitc model of the intravitreal pharmacokinetics of large molecules and the pharmacodynamic suppression of ocular vascular endothelial growth, Mole Pharmaceutics, 2016.
Winter, Man Made antibodies, nature, 1991.
Ward, Binding activities of a repoirtoire of single repertoire of single immunoglobulin variable domains, Letters to Nature, vol. 341, 1989.
Venkataramani, Design and characterization of Zweimaab and Doppelmab, Biochem and Biophysical Research, vol. 54, 2018.
Josephy, Neurotrophin receptor agosnists and antagonists as therapeutic agents, Neurobiology of Disease, vol. 97, 2016.
Brinkmann, The making of bispecific antibodies, MABS, vol. 9, 2017.
Gerber, Mice expressing a humanized form of VEGF-a may provide insights into the safety and efficacy of anti-VEFG antobidiues, Natl acad. 2007.
Hernandez, Neurotrophin receptor agonists and atagonists as therapetic agents, Neurobiology of disease, vol. 97, 2017.
Venkataramani, Design and characterization of Zweimab and Doppelmab, Biochem and Biophsical Research Commuications, 2018.
Brinkmann, Classification of bispecific antibodies, MABS, vol. 9, 2017.
Gerber, Mice expressing a humanized form of VEGF-A may provide insights into the safety and efficacy of anti-VEGF antibodies, PNAS, vol. 104, 2007.
Lefranc, IMGT unique numbering for immunoglobulin and T cell receptor variable domains, Dev. Comp. Immunol. vol. 27, 2003.
Guidecelli, IMGT/V—Quest, IMGT standardized analysis of the immunoglobulin and T cell receptor, Cold Spring Harb., 2011.
Chothia, Canonical Structures, J. Mole. 1987,.
Biakle, An Ig Primary Sequence exposure, Nature, 1975.
Lukas, Inhibition of C-1 mediated immune hemaolysis, Immunology, 1981.
Brunhouse, Isotopes of IgG, Mol. Immunology, 1979.
Burton, The Clq receptor xxite on immunoglobulin G. Nature, 1980.
Thommesen, Lysine 322 in the human IgG33, Mol. Immunolgy, 2000.
Idusogie, Mapping of the C1q binding site on Rituxan, J. of Immunology, 2000.
Hezareh, Effector function activities of a panel of mutants of a broadly neutralizing antibody, J. Virology, 2001.
Morgan, The N-terminal end of the CH2 domain of chimeric human IgG1 anti-HLA-DR, Immunology, 1995.
Kohler, Continuous cultures of fused cells, Nature, 1975.
Norderhaug, Versatile vectors for transient and stable expression of recombinant antibody, J. Immunology Methods, 1997.
Billetta, Chimeric antibodies, Int. Immunol. Methods, 1997.
Knappik, Fully synthetic human combinatorial antibody librairies, J. Mole. Biol., 2000.
Carmen, Concepts in Antibody phage display, Briefings in Functional Genomics and Proteomics, 2002.
Lonberg, Human antibodies from transgenic mice, Int. Rev. Immunol., 1995.
Bruggemann, Production of human antibody repertoires in transgenic mice, Curr. Opin. Biotechnol., 1997.
Huston, Medical Appplications of Single Chain Antibodies, Int. Reviews of Immunol., 1993.
Revets, Nanobodies as Novel Agents, Expert Opinion Biol., 2005.
Srinivasan, Immunomodulatory Pepetides, Current Protein Pept, 2005.
Marks, By Passing Immunization, Biotechnology, 1992.
Barbas, In vitro evolution of a neutralizing human antibody, Proc. Nat. Sci, vol. 91, 1994.
Schier, Identification of functional and structural amino acid residues, Gene, vol. 169, 1996.
Karlin, Pro. Natl. Acad. Sci. Methods for assessing the statistical significance of molecular sequence features, 1990.
Altschul, Gapped BLAST and PSI-BLAST, Nucleic Acids Res., 1997.
Torelli, Advance and ADAM: two algorithms for the analysis of global similarity between homologous informational sequences, Comput., Appl. Biosci., 1994.
Pearson, Improved tools for biological sequence comparison, Proc. Natl. Acad, Sci, 1988.
Higgins, Using CLUSTAL for Multiple sequence alignments, Methods Enzymol., 1996.
Ferrara, Vascular Endothelial Growth Factor, Endocrine Rev., 2004.
Hoeben, Vascular Endothelial Growth Factor and Angiogenesis, Pharmacol., vol. 56, 2004.
Ferrara, Molecular and biological properties of vascular endothelial growth factor, J. Mol. Med, 1999.
Hybird hubrididomas, Milstein, Nature, 1983.
Traunecker, Bispecific single chain molecules, EMBO, 1991.
Brennan, Preparation of Bispecific Antibodies, Science, 1985.
Formation of a bispecific antibody, Kostelny, J, Immunol., 1992.
Holliger, Diabodies, Proc. Natl., Acad., Sci., 1993.
Gruber, Efficient tumor cell lysis mediated by a bispecific single chain antibody, J. Immunol., 1994.
Tutt, Trispecific F(ab')3 derivatives that use cooperative signaling via the TCR/CD3 complex, J. Immunol., 1991.
Orlandi, Cloning immunoglobulin variable domains for expression by the polymerase chain reaction, J. Immunol., 1991.
Winter, Proc. Natl. Acad. Sci., 1989.
Kozbor, Specific Immunoglobulin production and enhanced tumorigenicity follwing ascites growth, J. Immunol. Methods, 1985.
Cote, Gernation of human monoclonal antibodies reactive with cellular antigens, Mol. Cell. Biol. 1984.
Single-step assembly of a gene and entore plasmid from large numbers of oligodeoxyribonucleotides, Stemmer, Gene, 1995.
Altschul, Stephen F. et al. "Basic local alignment search tool" (1990) Journal of Molecular Biology, vol. 215, Issue 3, 403-410.
Bijak, Emil et al. "Reformatting of scFv Antibodies into a the scFv-Fc format, and their Downstream Purification" Monoclonal Antibodies, 2014, vol. 1131, 315-334.
Boackle, Robert J. et al. "An IgG primary sequene exposure theory for complement activation using synthetic peptides" (1979) Nature, 282, 742-743.
Cole, S.P.C. et al. "Human monoclonal antibodies" (1984) Molecular and Cellular Biochemistry, 62, 109-120.
Ferrara, Napoleone et al. "The Biology of Vascular Endothelial Growth Factor" (1997) Endocrine Reviews, vol. 18, No. 1, 4-25.

(56) References Cited

OTHER PUBLICATIONS

Gershoni, Jonathan M. et al. "Epitope Mapping, The First Step in Developing Epitope-Based Vaccines" (2007) Biodrugs, 21(3), 145-156.

International Search report and written opinion for PCT/Ep2021/079010 dated Feb. 7, 2022.

Karlin, Samuel et al. "Applications and statistics for multiple high-scoring segments in molecular sequences" (1993) Proc. Natl. Acad. Sci., vol. 90, 5873-5877.

Kostelny, Sheri A. et al. "Formatoin of a Bispecific Antibody by the USe of Leucine Zippers" (1992) The Journal of Immunology, vol. 148, 1547-1553.

Merkouris, Spyros et al. "Fully human agonist antibodies to TrkB using autocrine cell-based selection from a combinatorial antibody library" (2018) PNAS, vol. 115, 10 pages.

Merkouris, Spyros et al. "Function-Based Selection of TrkB Activating Antibodies: Characterization of a Full BDNF Agonist Antibody on Human Neurons" Supplemental Appendix: Methods, Figures and Table Legends, (2018) PNAS, vol. 10, 10 pages. www.pnas.org/cgi/doi/10.1073/pnas. 1806660115.

Miller, Ami et al. "Multimeric antibodies with increased valency surpassing functional affinity and potency thresholds, using novel formats" (2020) MABS, vol. 12, No. 1, e1752529, 11 pages.

Milstein, C. et al. "Hybrid hybridomas and their use in immunohistochemistry" (1983) Nature, 537-540.

Muchekehu, Ruth et al. The effect of Molecular Weight, PK, and Valency on Tumor Biodistribution and Efficacy on Antibody- Based Drugs, (2013) Translational Oncology, vol. 6, No. 5, 562-572.

Riechmann, Lutz et al. "Reshaping human antibodies for therapy", (1988) Nature, vol. 332, 323-327.

Stemmer, Willem P.C. et al. "Single-step assembly of a gene and entire plasmid from large Nos. of bligodeoxyribonucleotides" (1995) Gene, 164, 49-53.

Wang, Shudan, et al. "Therapeutic potential of a TrkB agonistic antibody for Alzheimers disease" (2020), Theranostics, vol. 10, 15, 6854-6874.

Ward, E. Sally et al. "Binding activities of a repoirtoire of single immunoglobulin variable domains secreted from *Escherichia coli*", Letters to Nature, (1989) vol. 341, 544-546.

Wermuth, C.G. et al. "Glossary of Terms used in Medicinal Chemistry" (1998) Pure & Appl. Chem., vol. 70, No. 5, 1129-1143.

\* cited by examiner

FIG.2 A-B
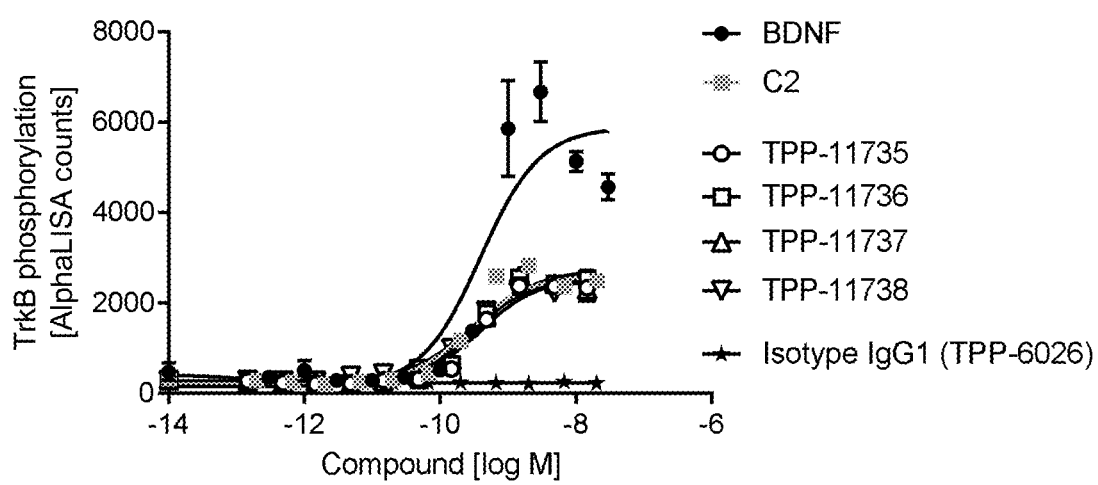
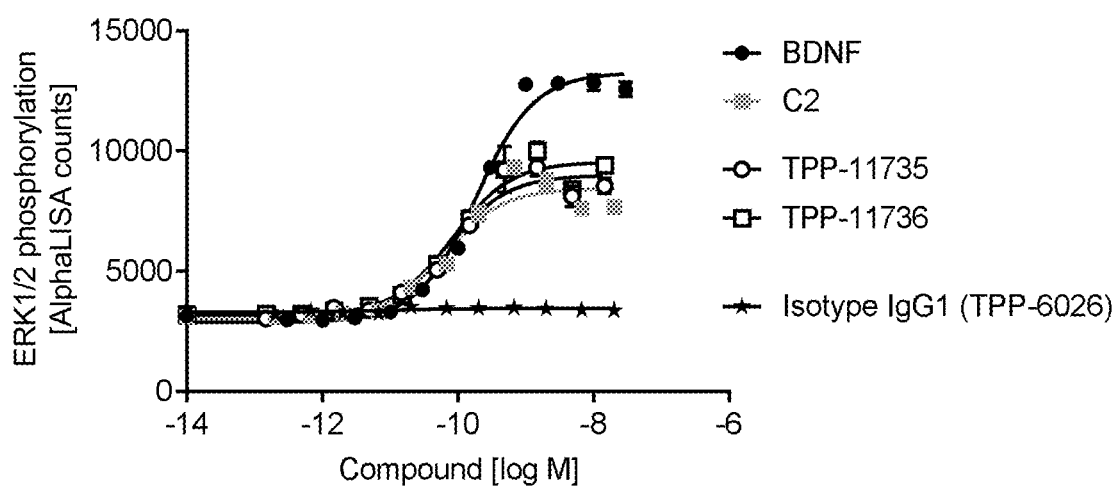

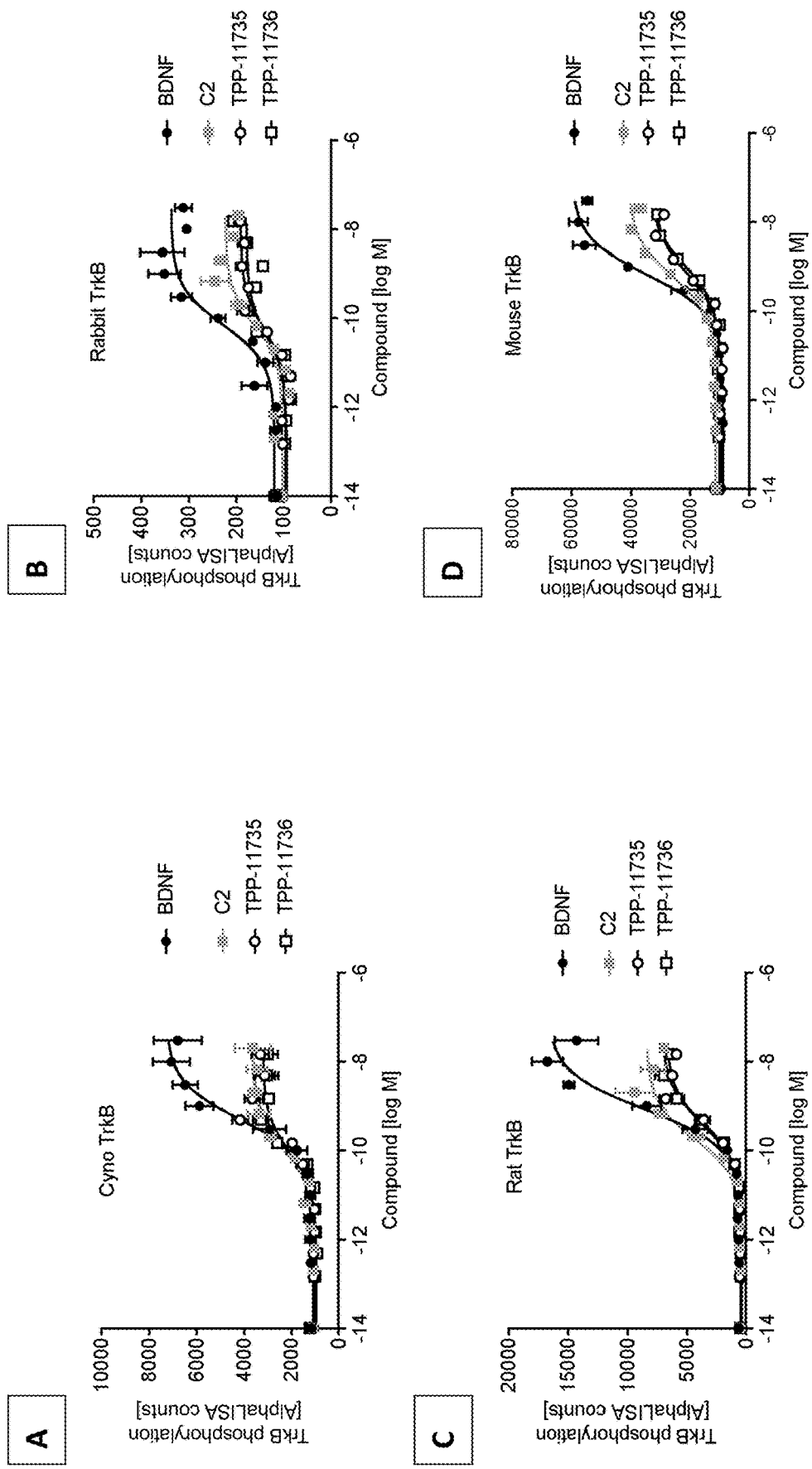
FIG. 3 A-D

FIG.4 A-C
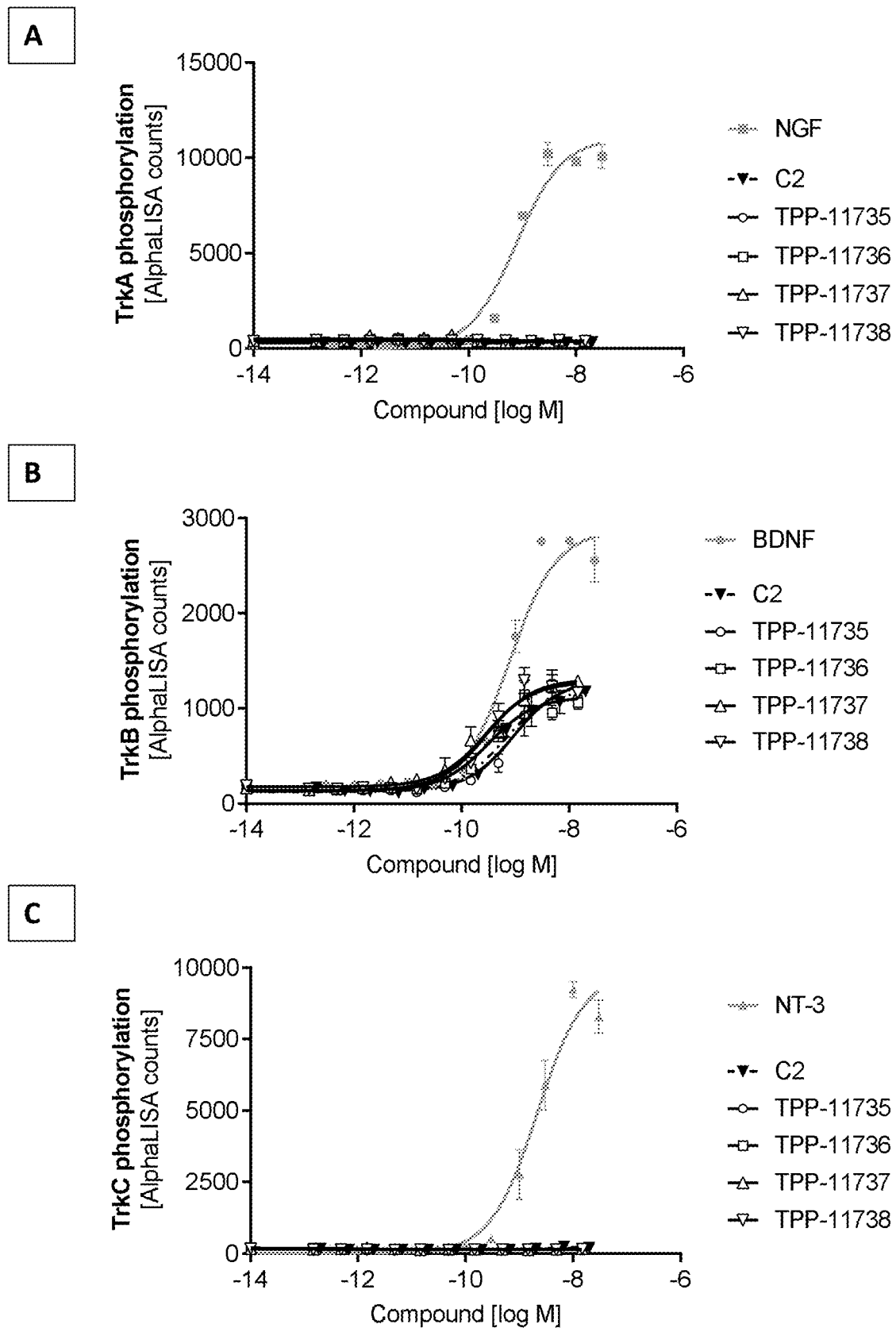

FIG.5 A-B
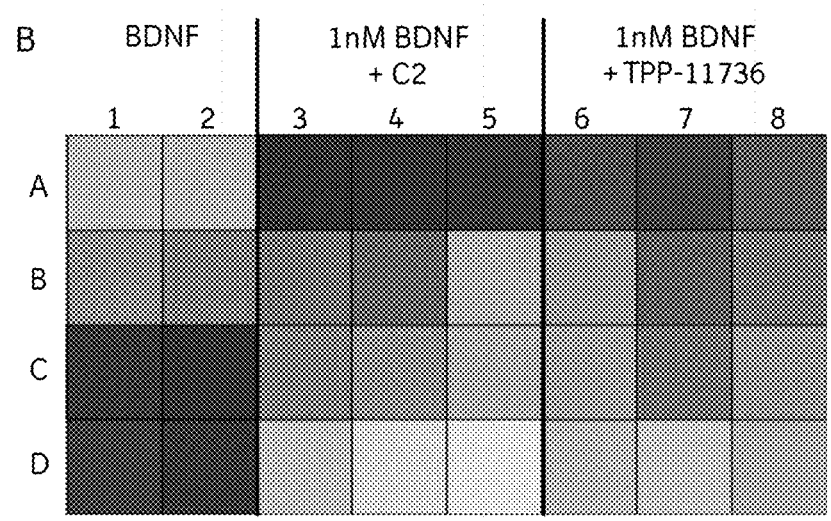

FIG.11 A-E
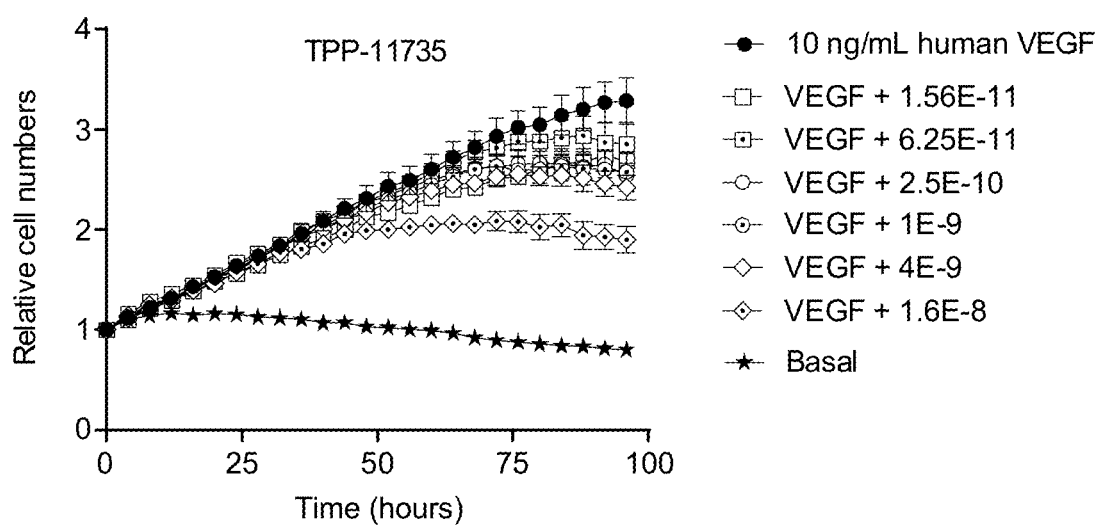
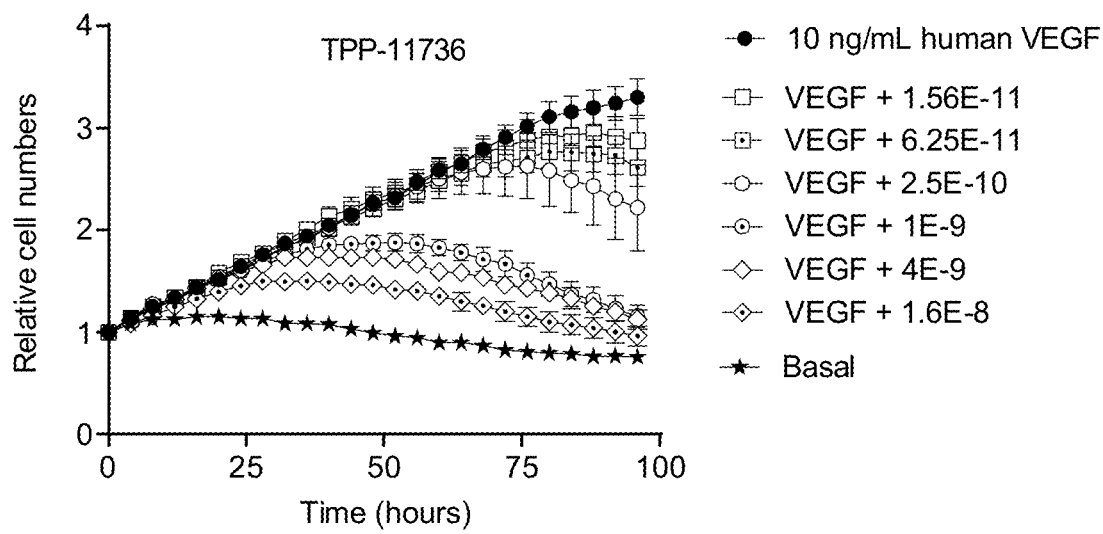

FIG.11 A-E continued
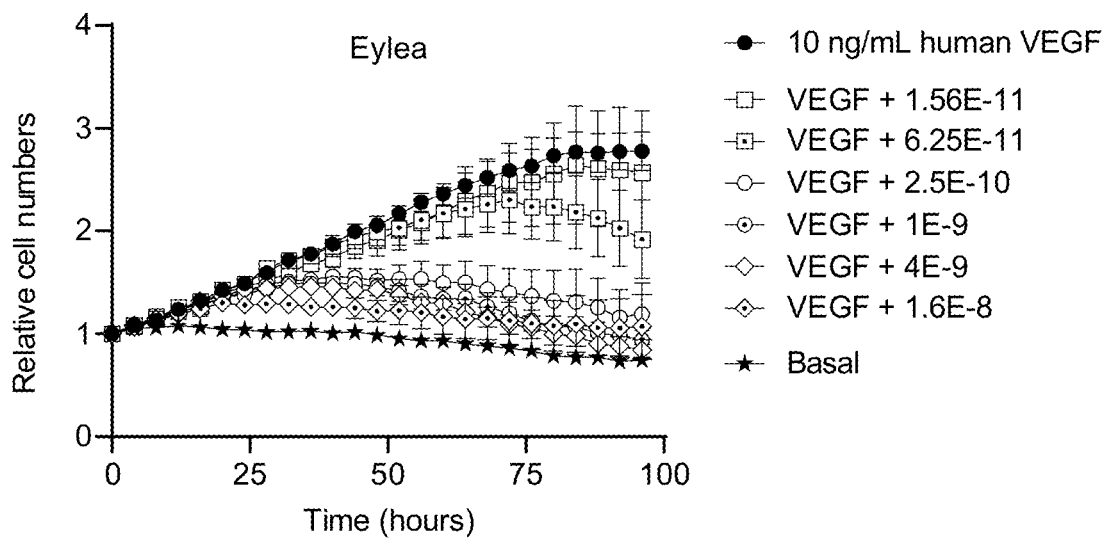
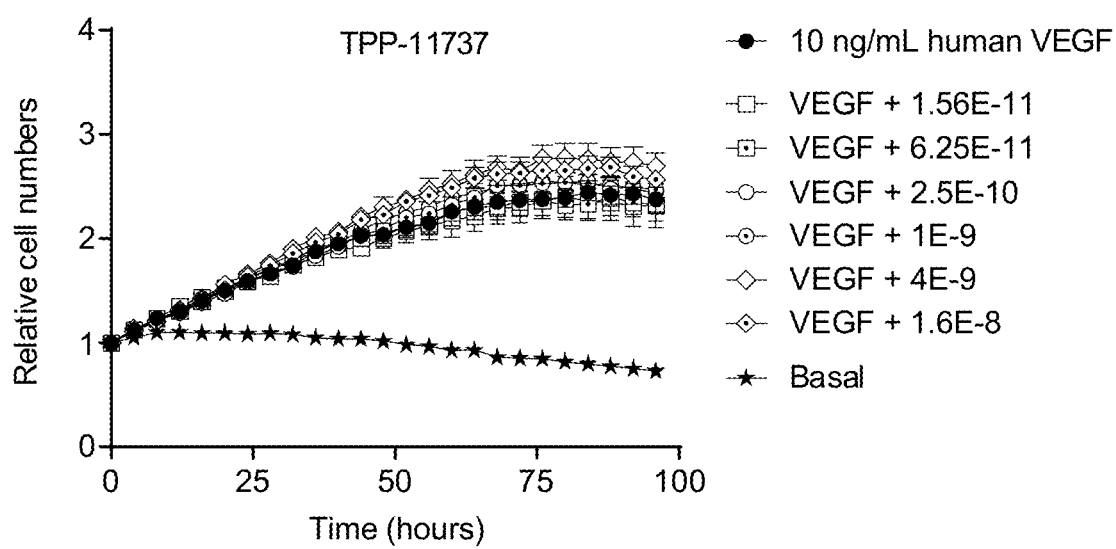

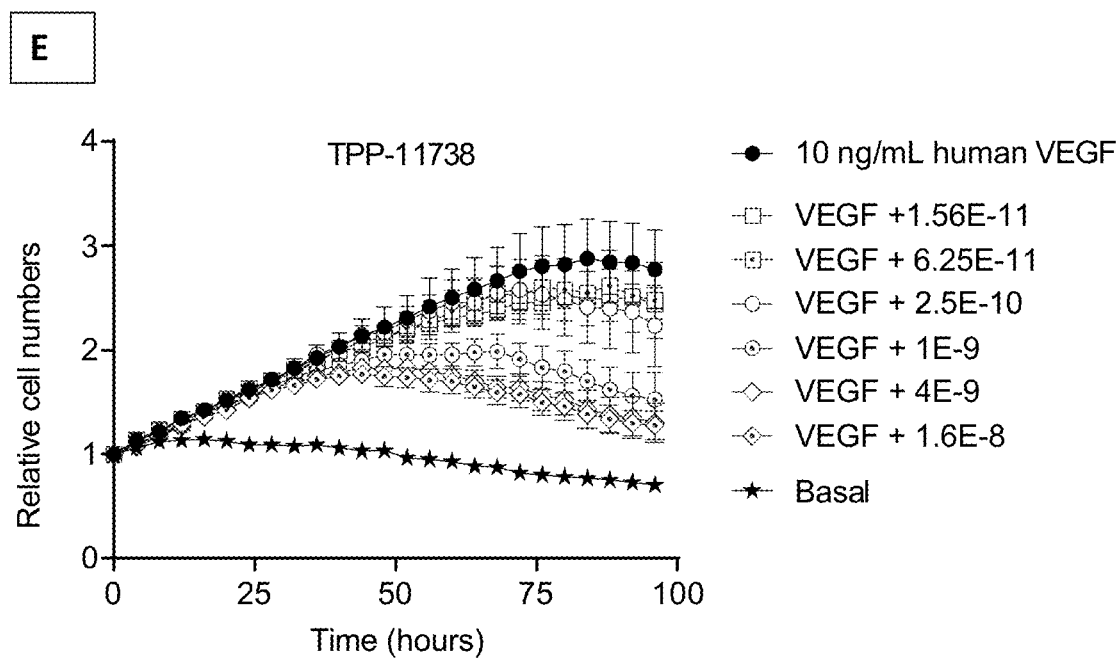
FIG.11 A-E continued

FIG.14 A-B

FIG.17 A-C
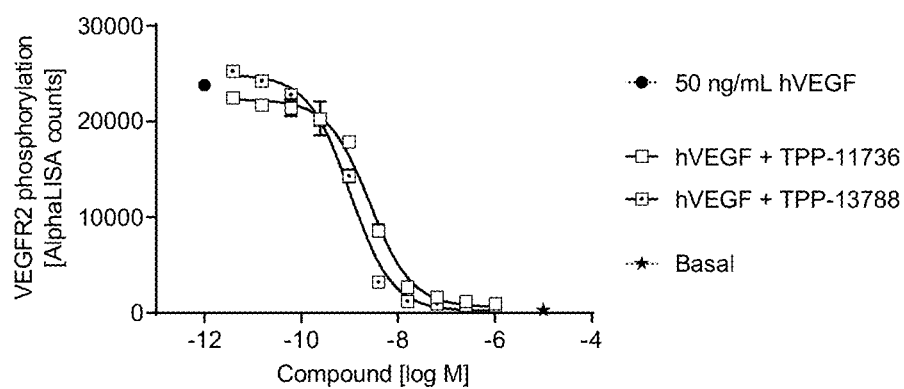
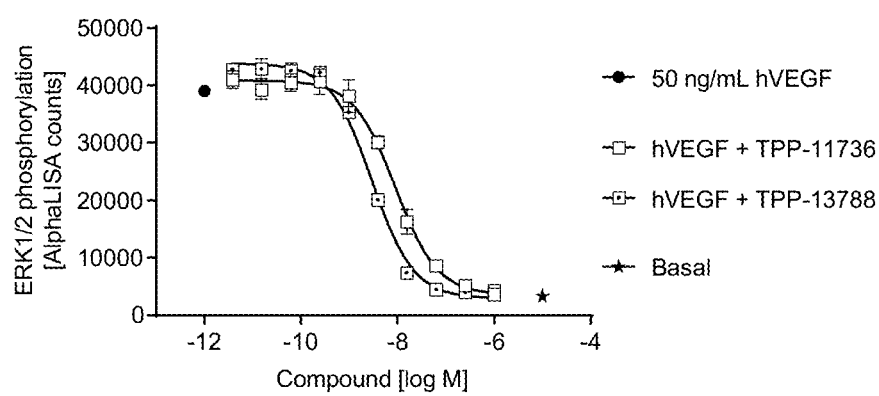
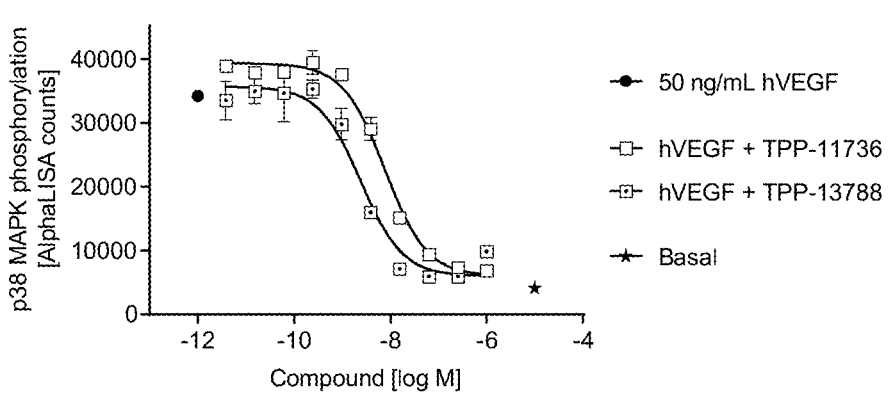

FIG.26 A-B
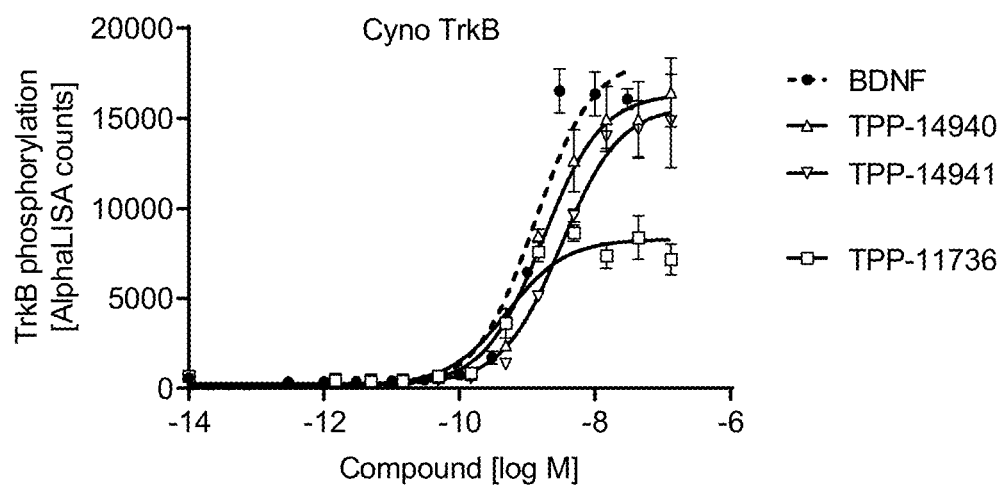
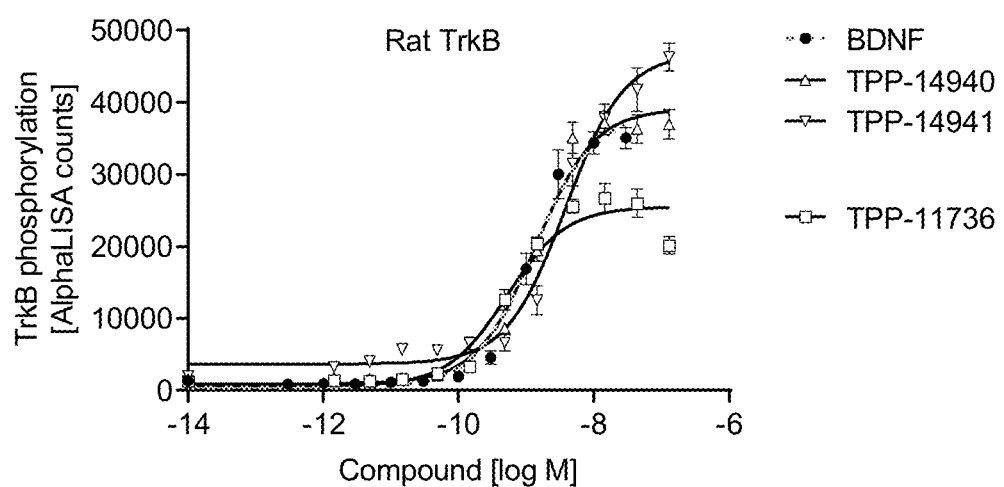

FIG.27 A-C
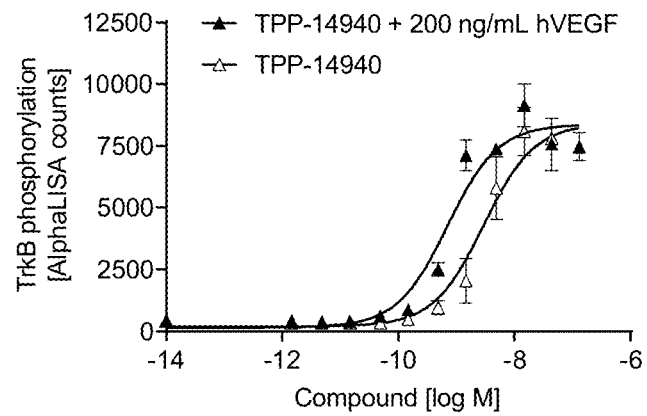
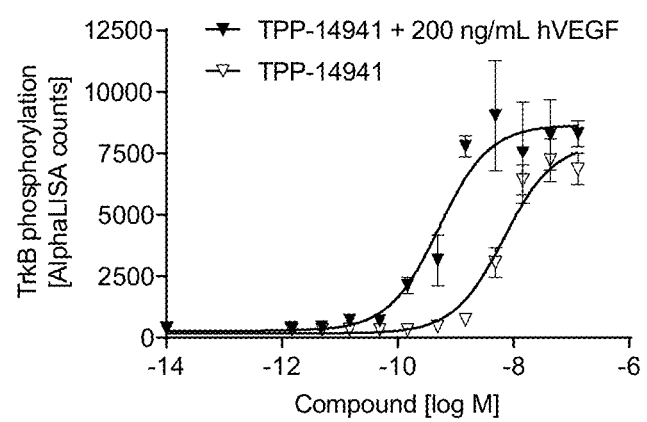
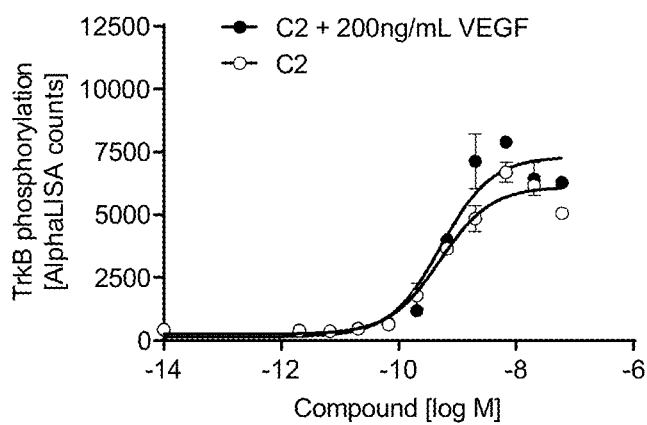

FIG.28 A-C
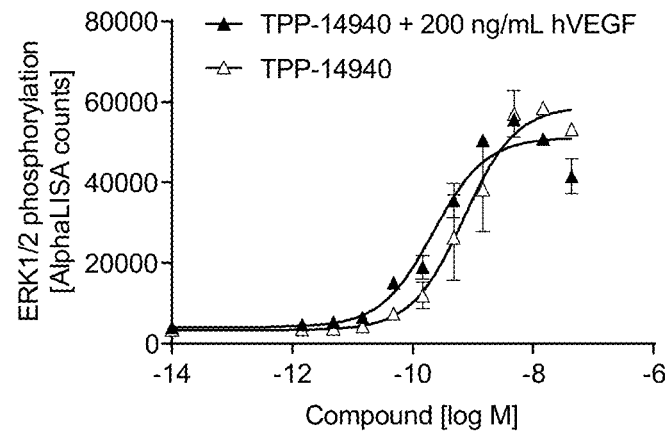
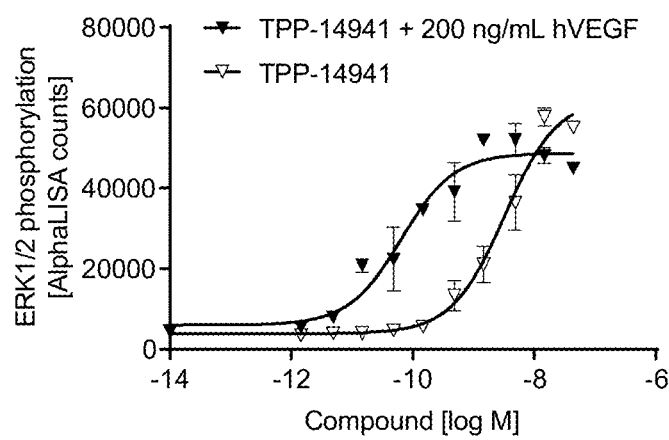
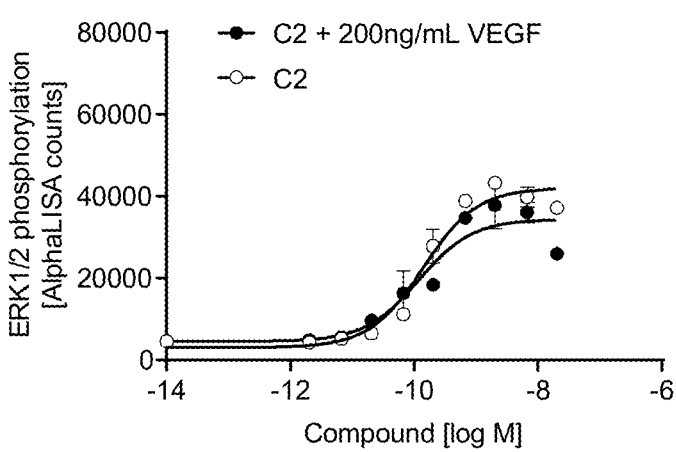

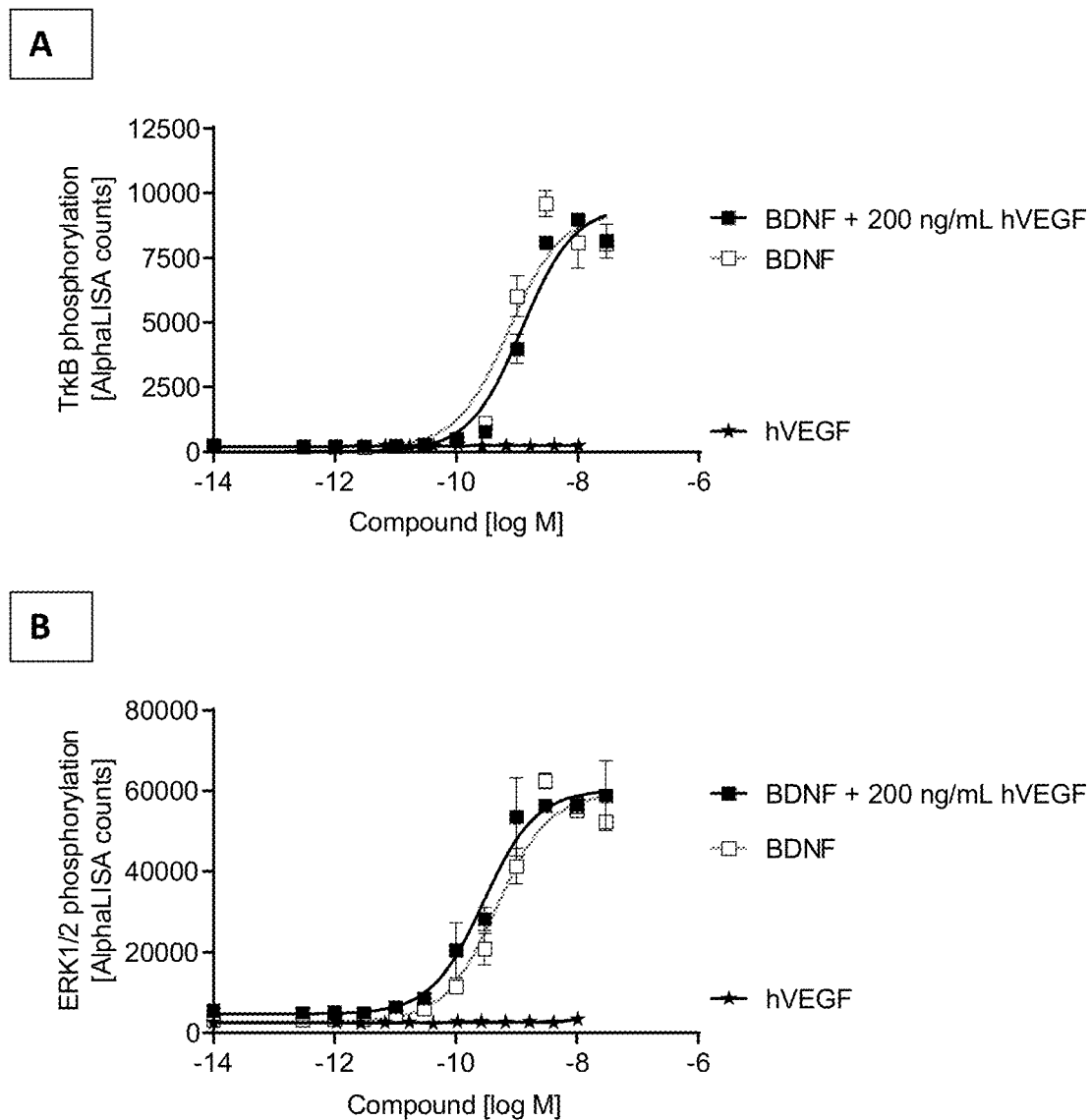
FIG.29 A-B

FIG. 30 A-C
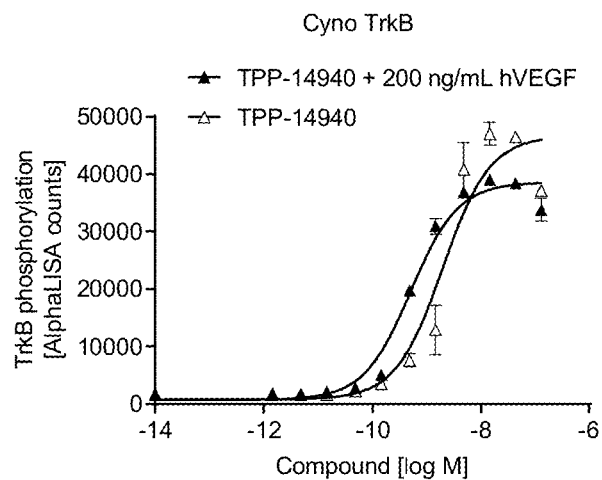
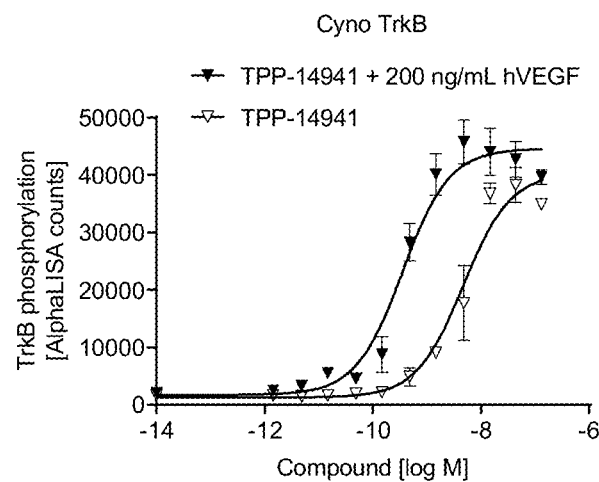
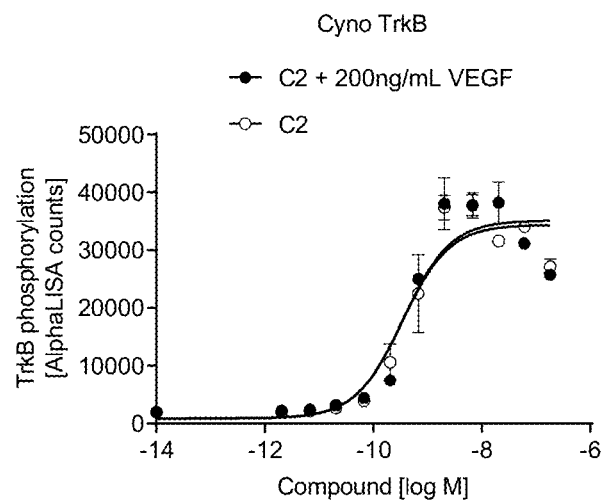

FIG.31 A-C
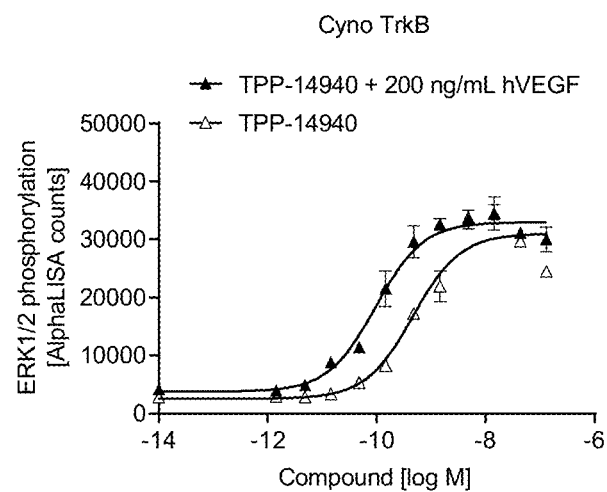
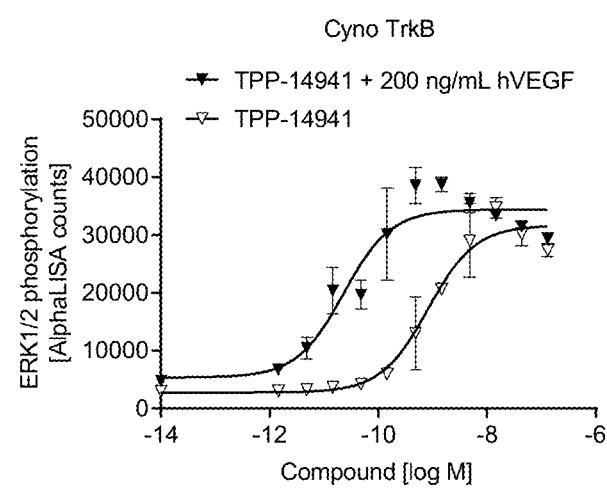
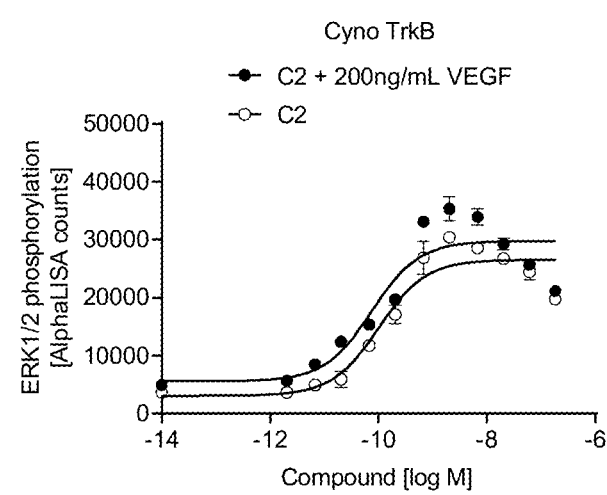

FIG.32 A-C
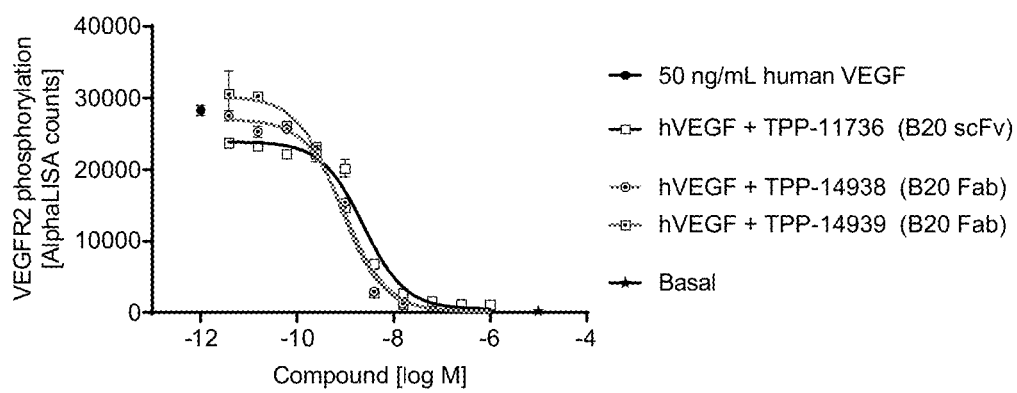
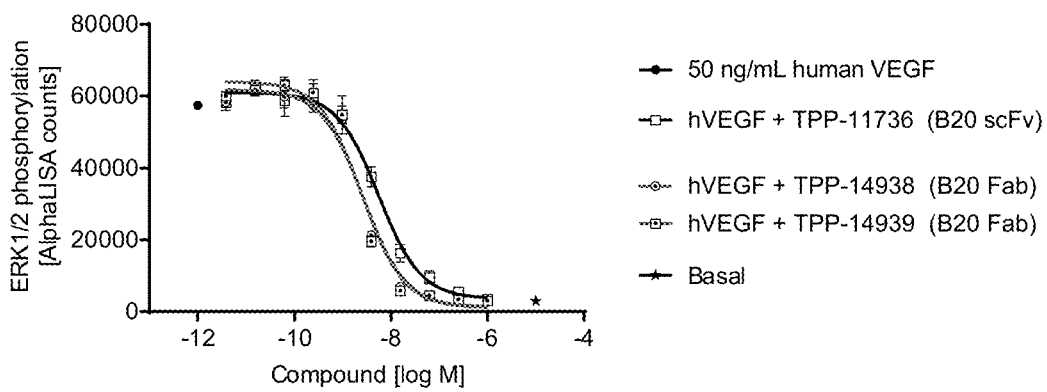
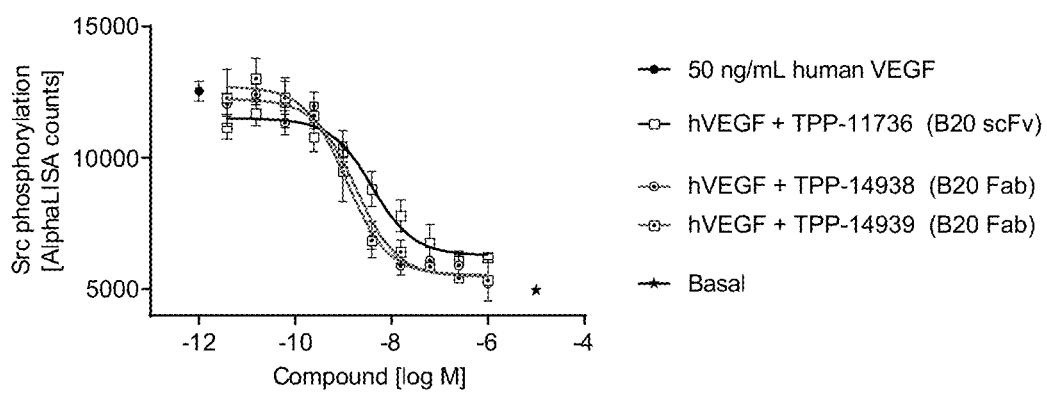

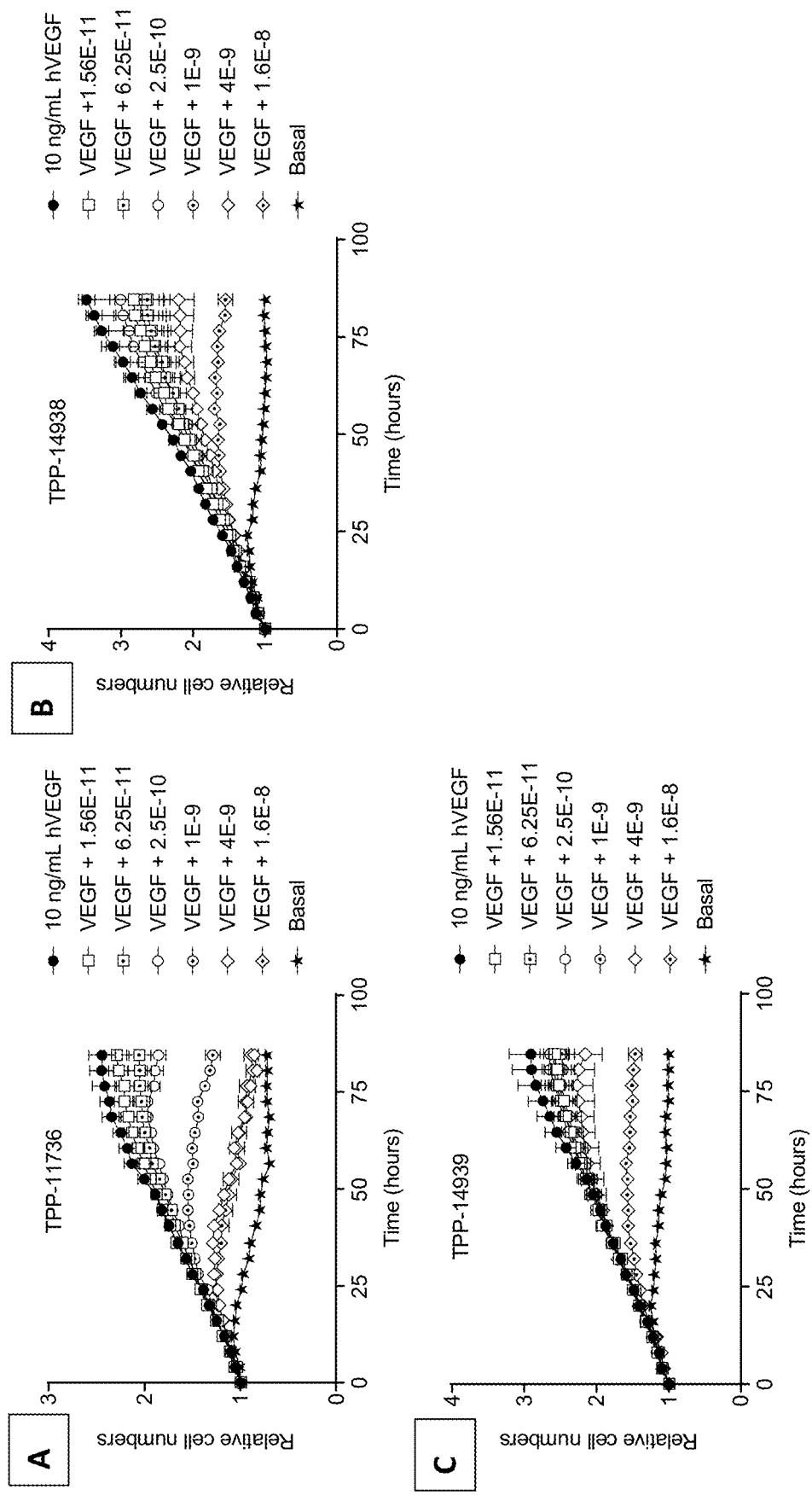
FIG.33 A-C

FIG.34 A-C
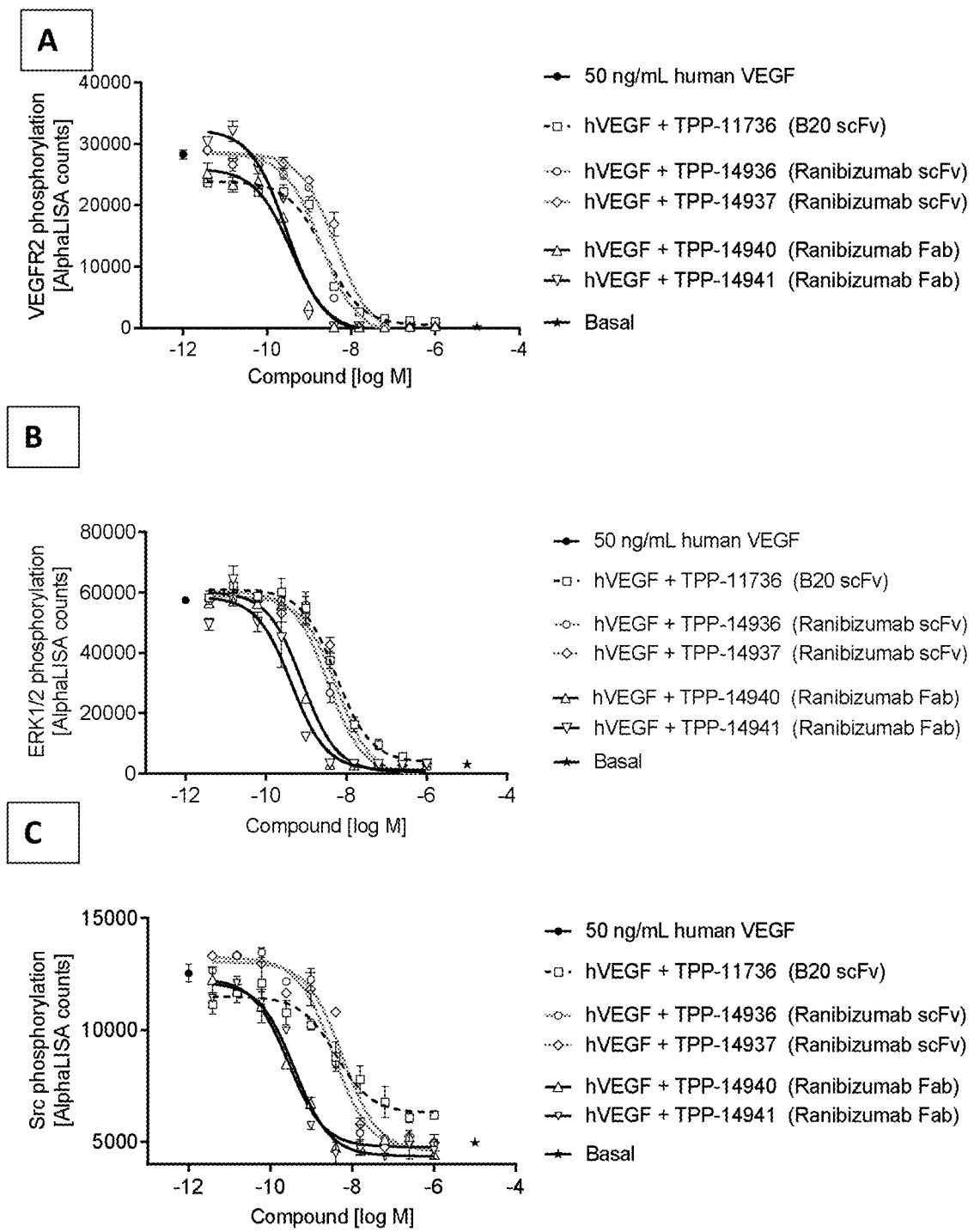

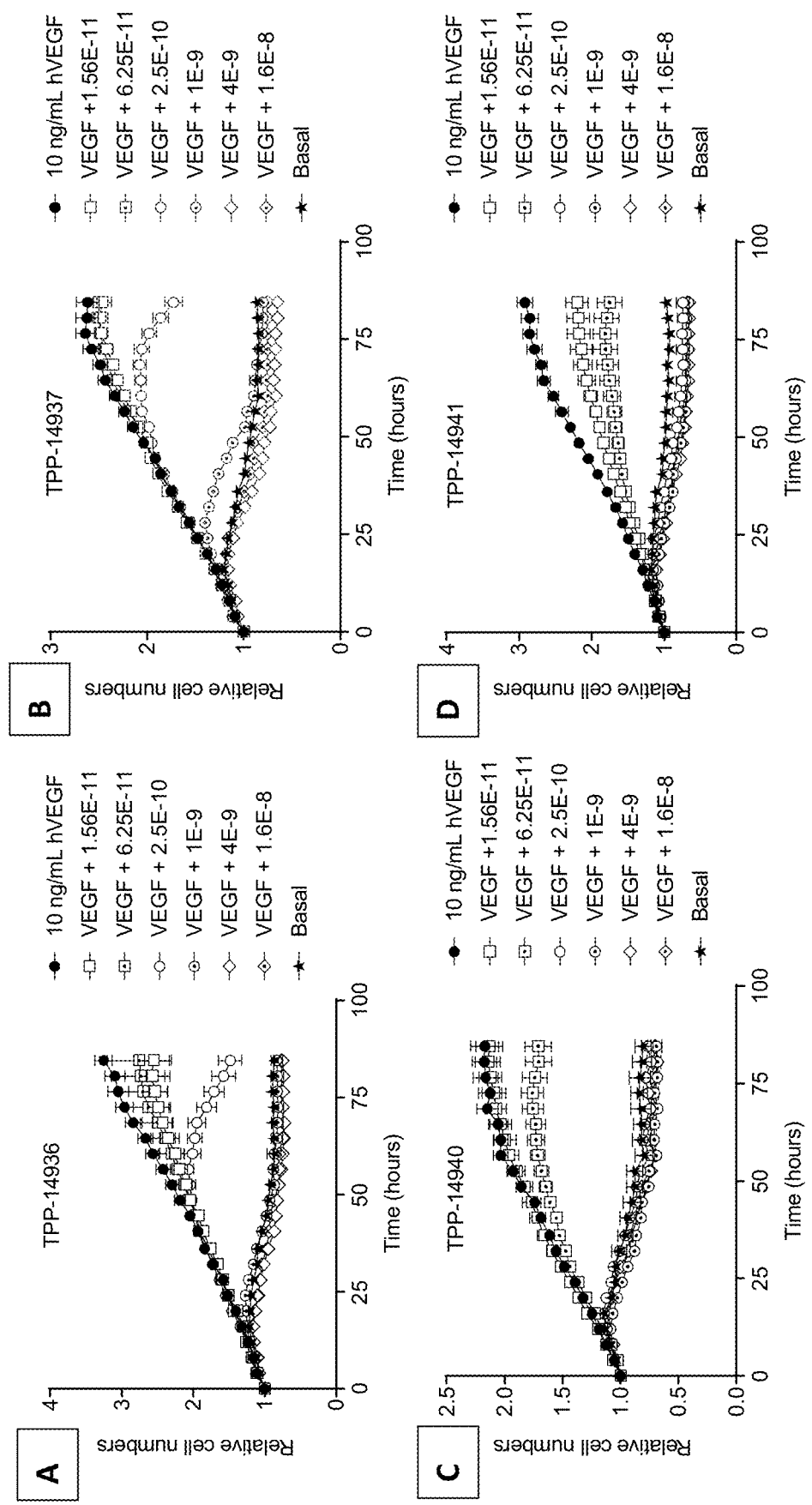
FIG.35 A-D

FIG.36 A-C
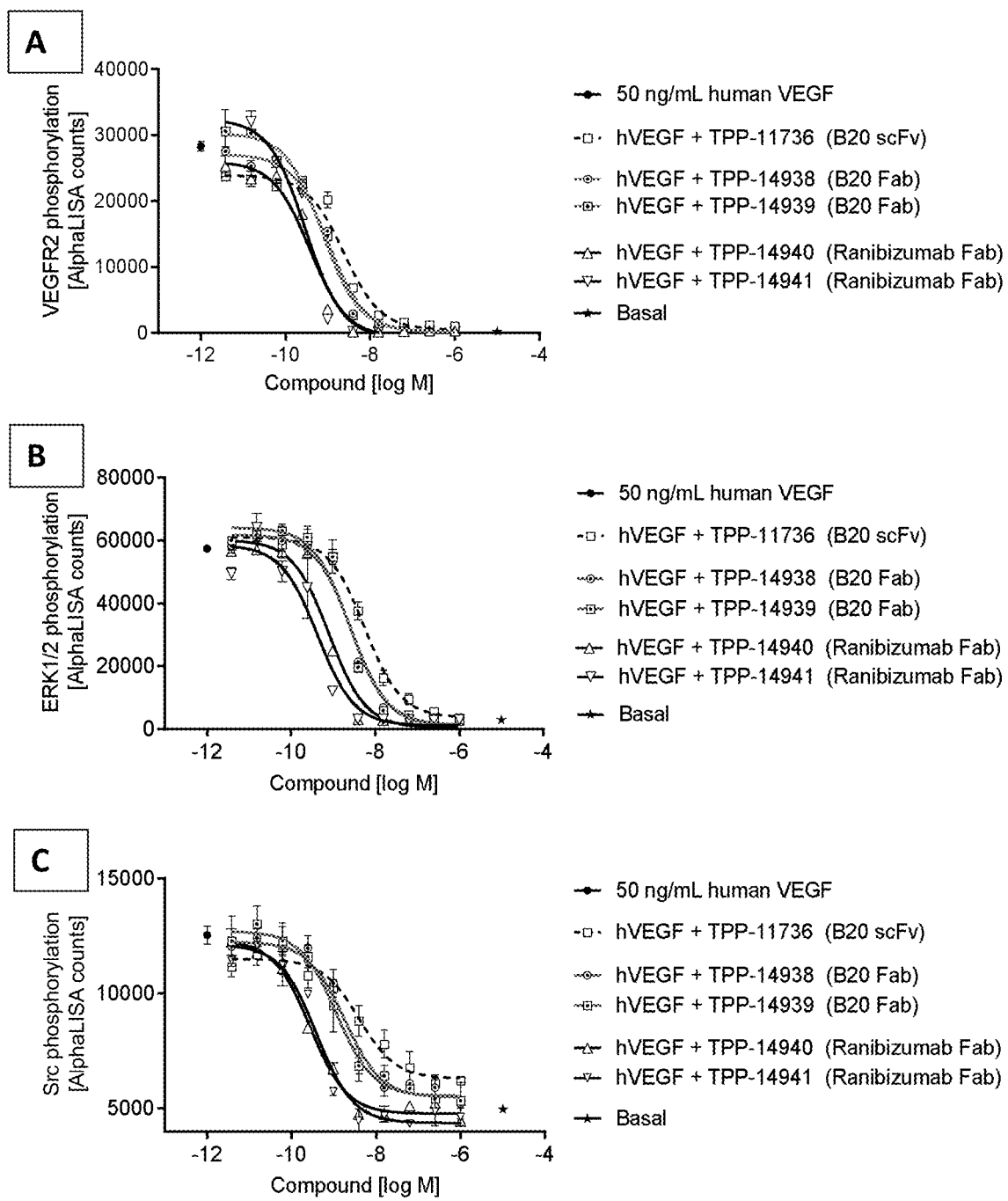

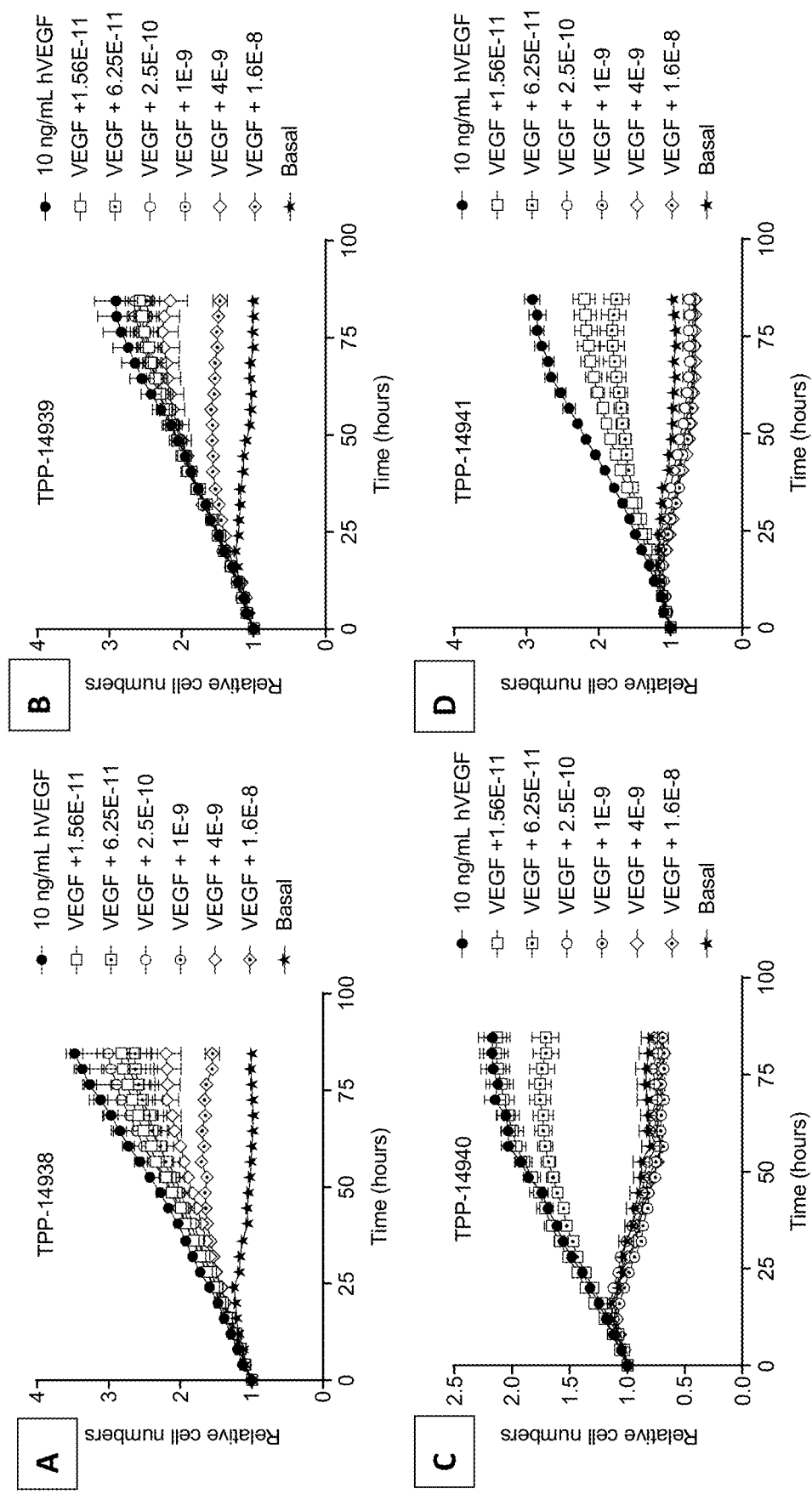
FIG. 37 A-D

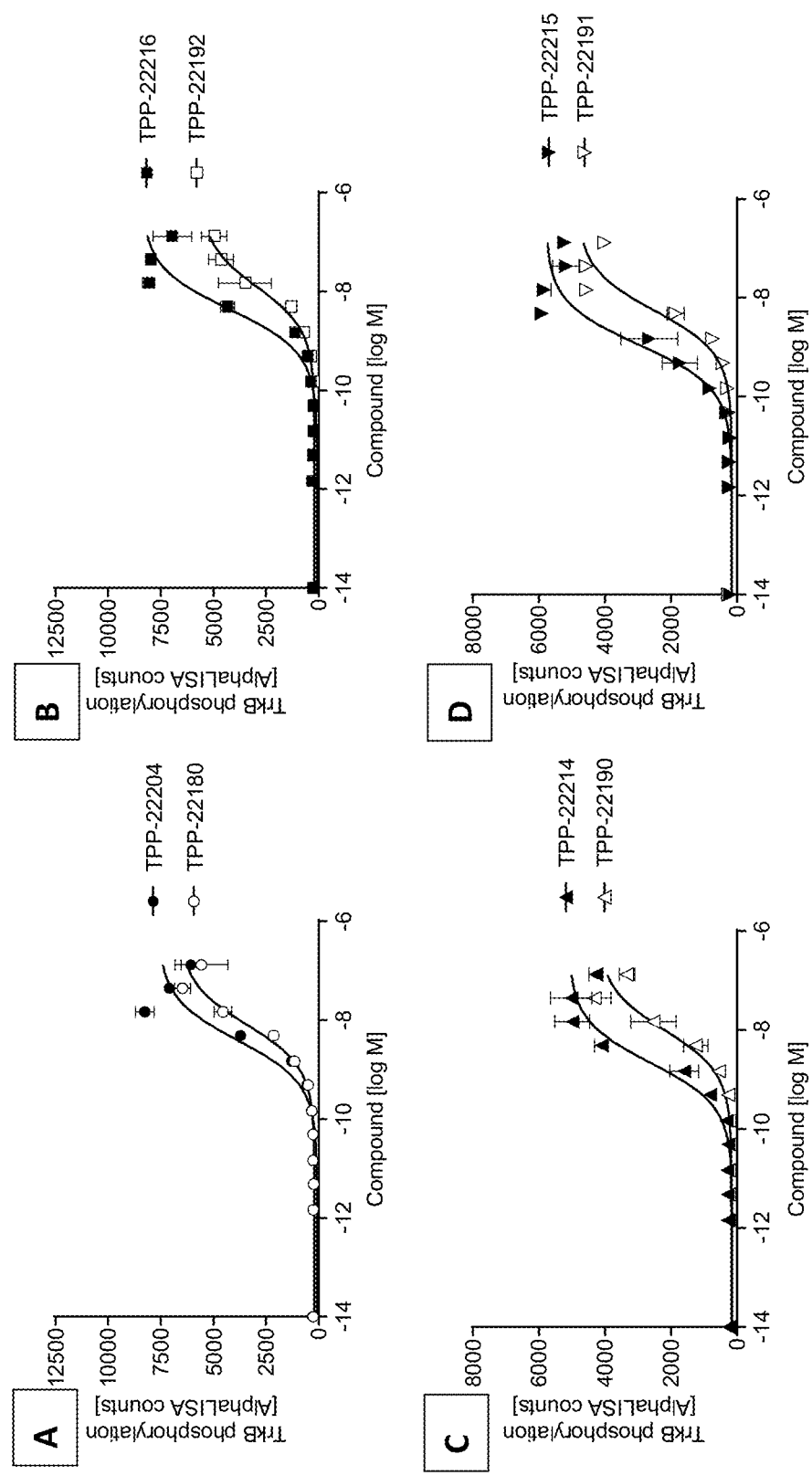

FIG.45 A-B
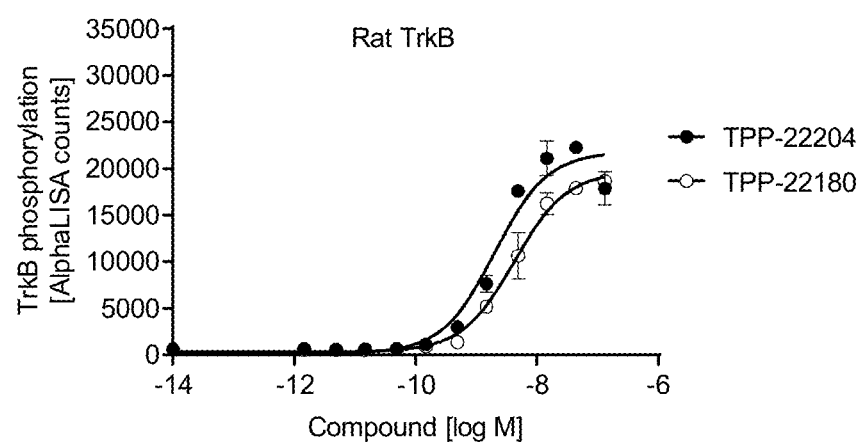
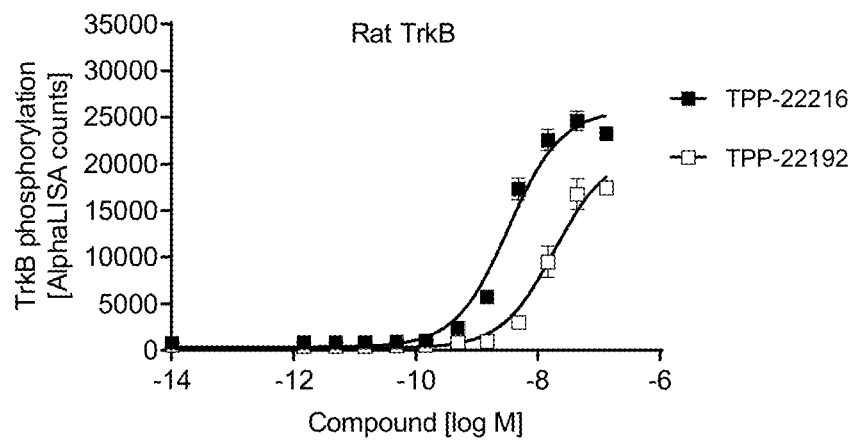

FIG.46 A-C
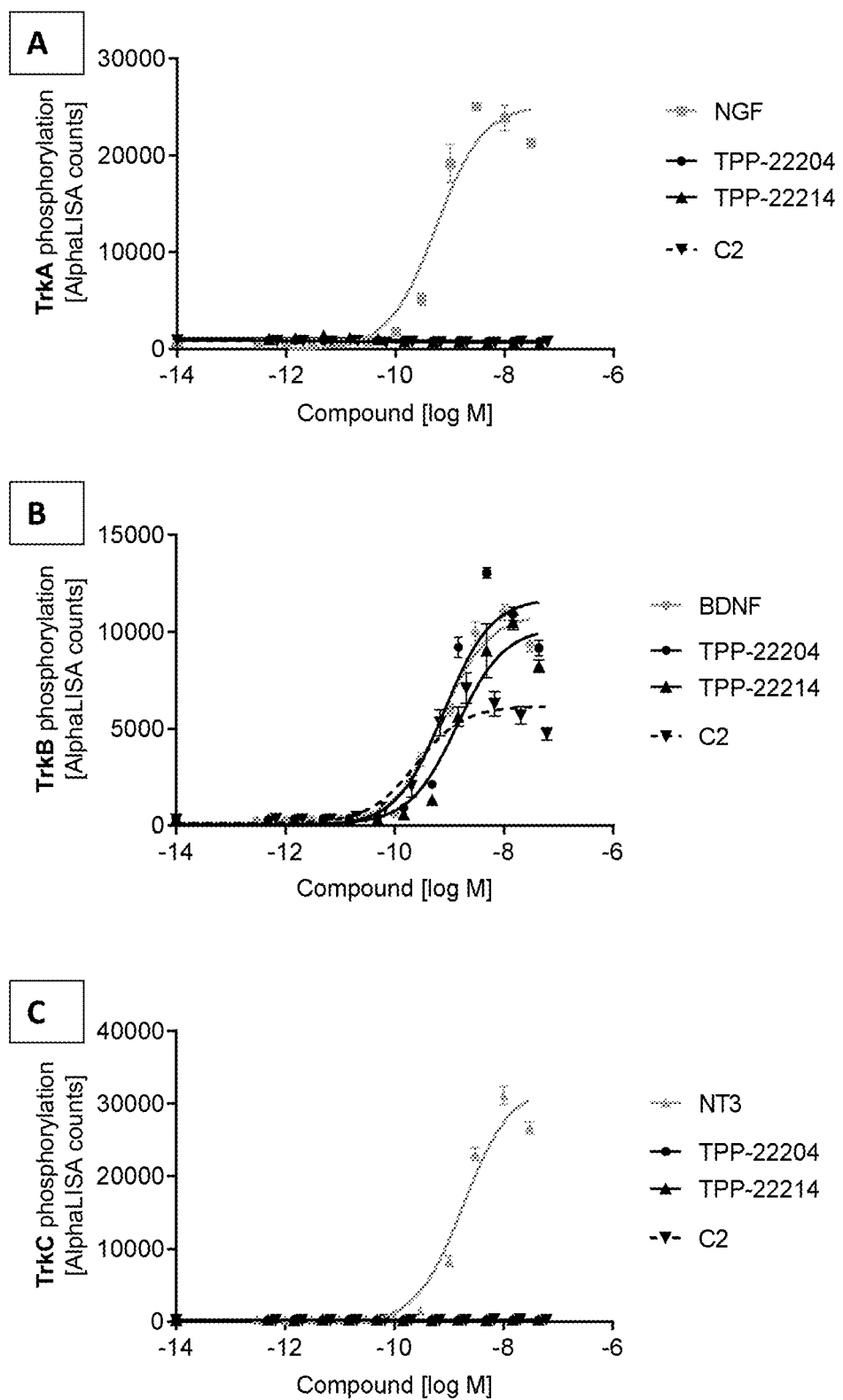

FIG.47 A-B
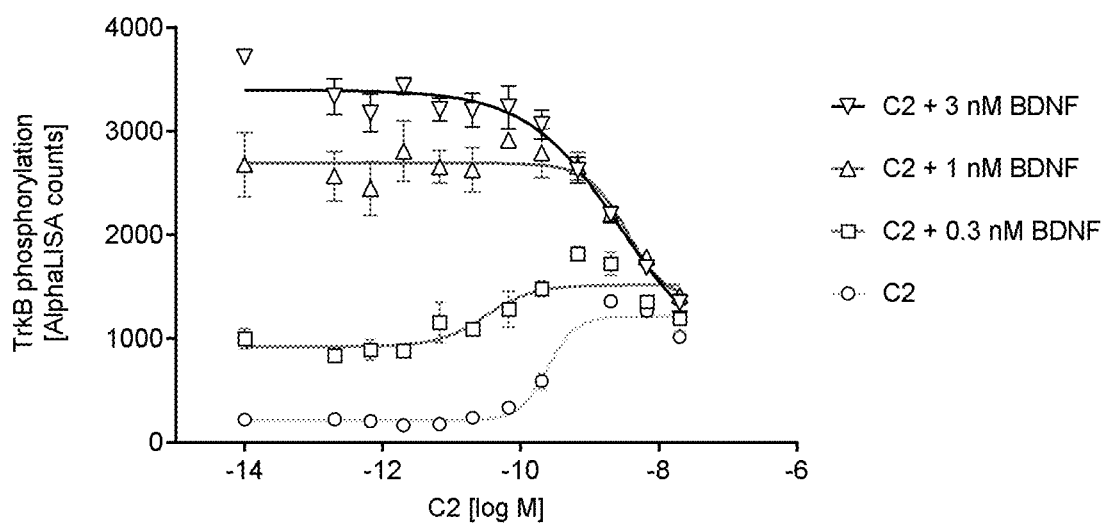
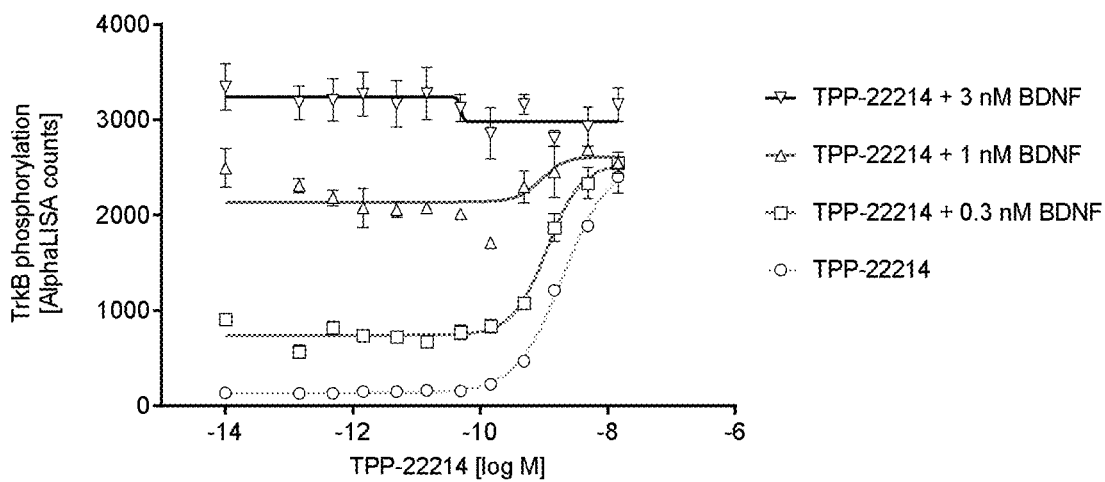

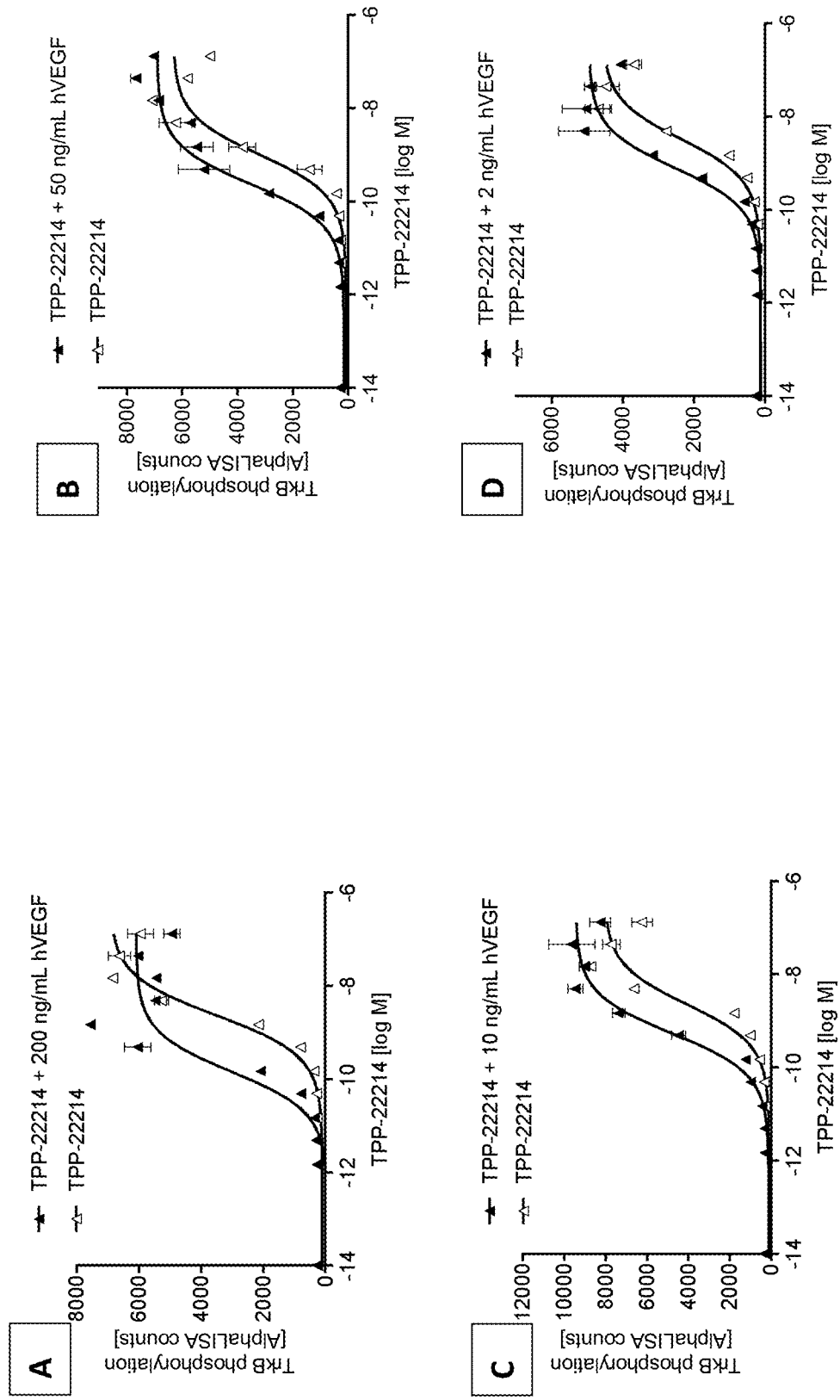
FIG.48 A-D

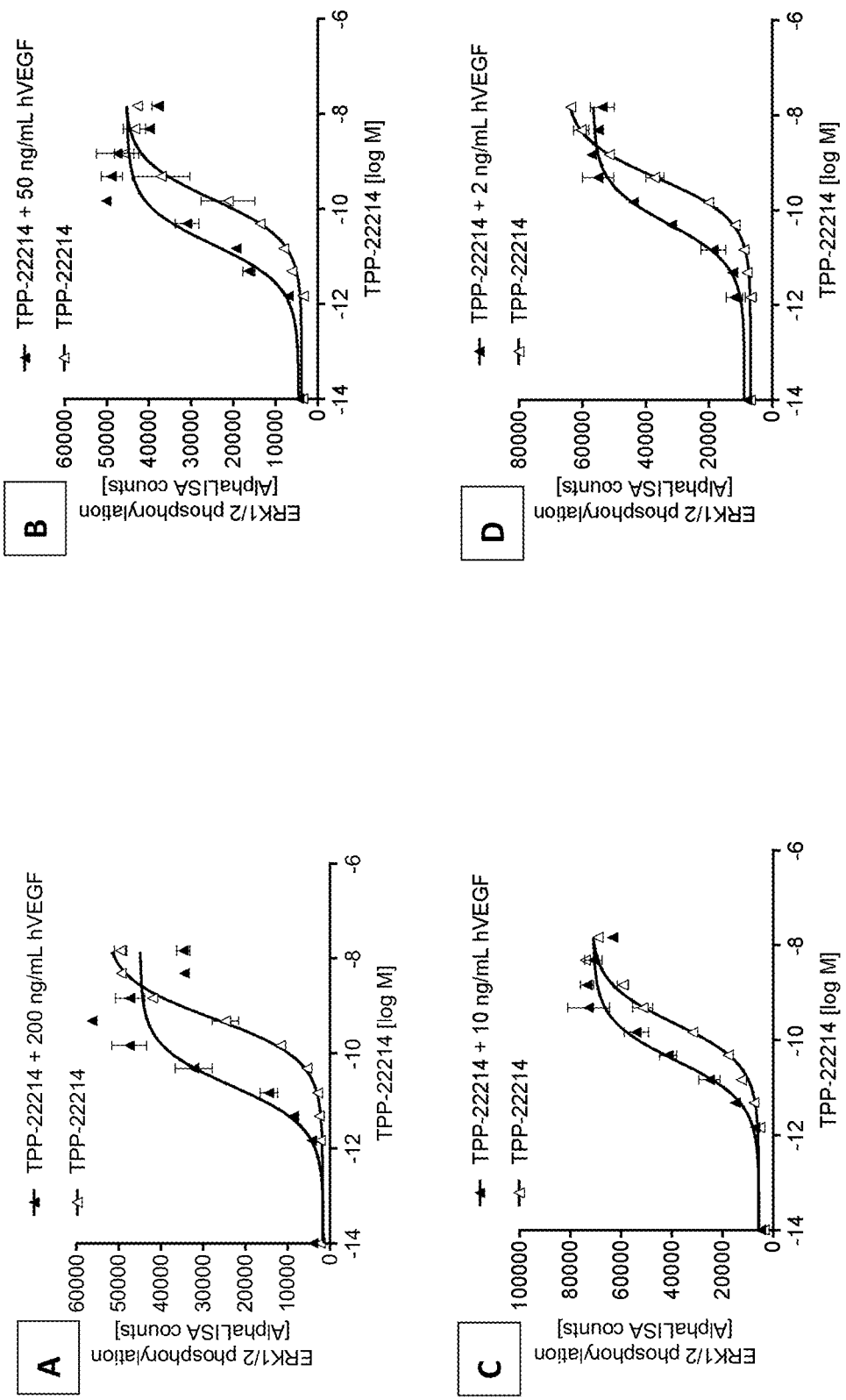
FIG. 49 A-D

FIG.51 A-C

FIG.53 A-B
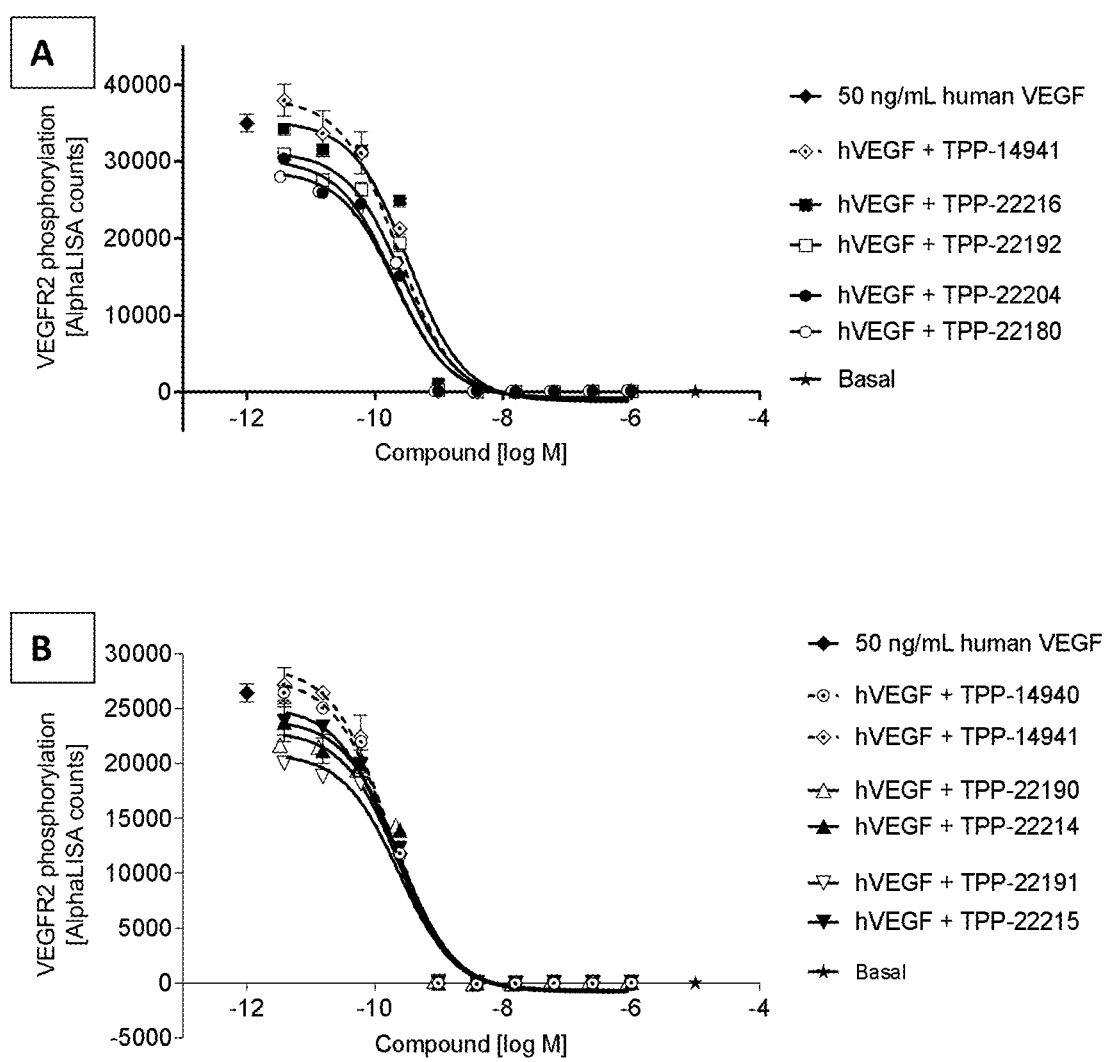

FIG.54 A-B
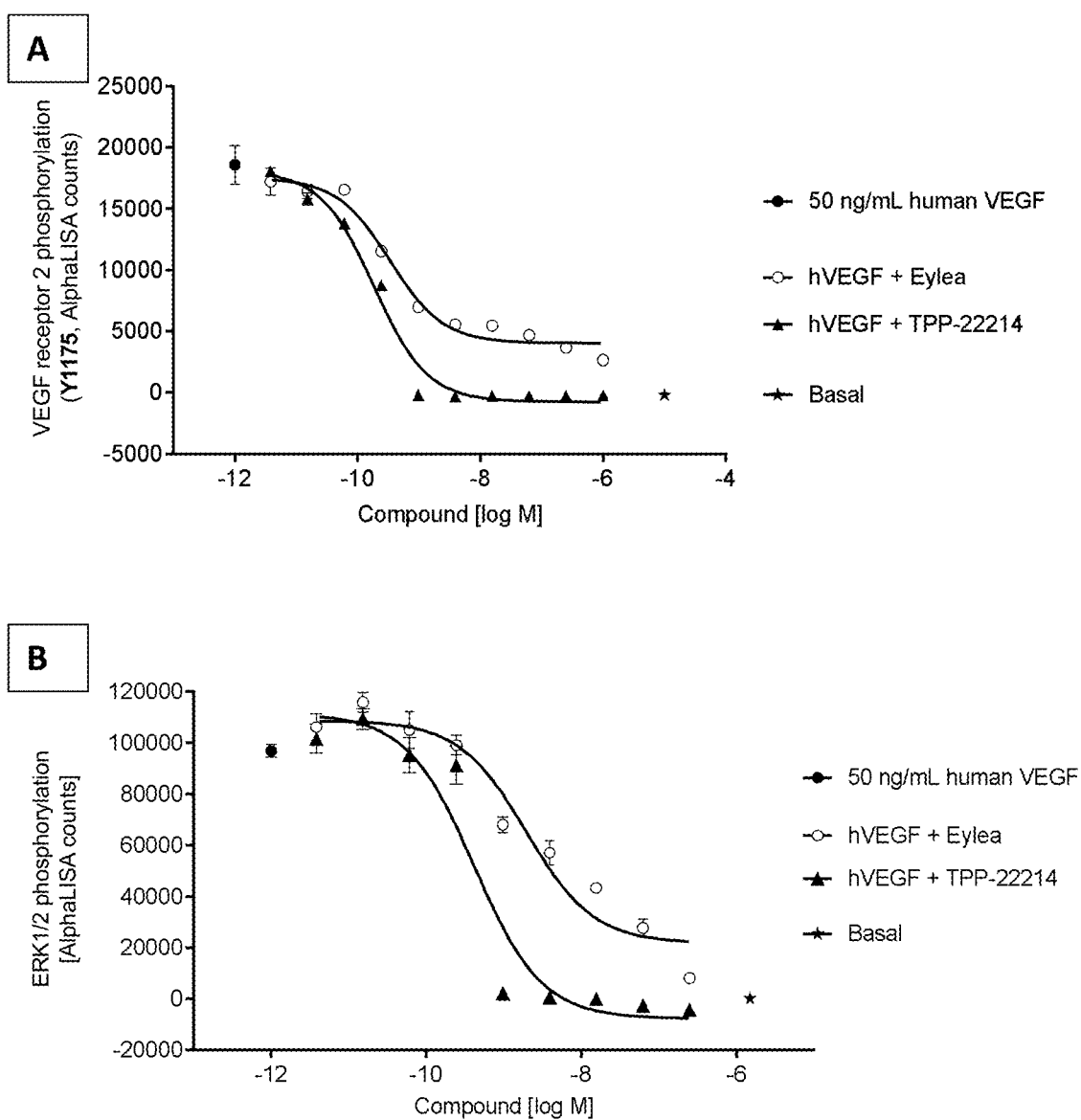

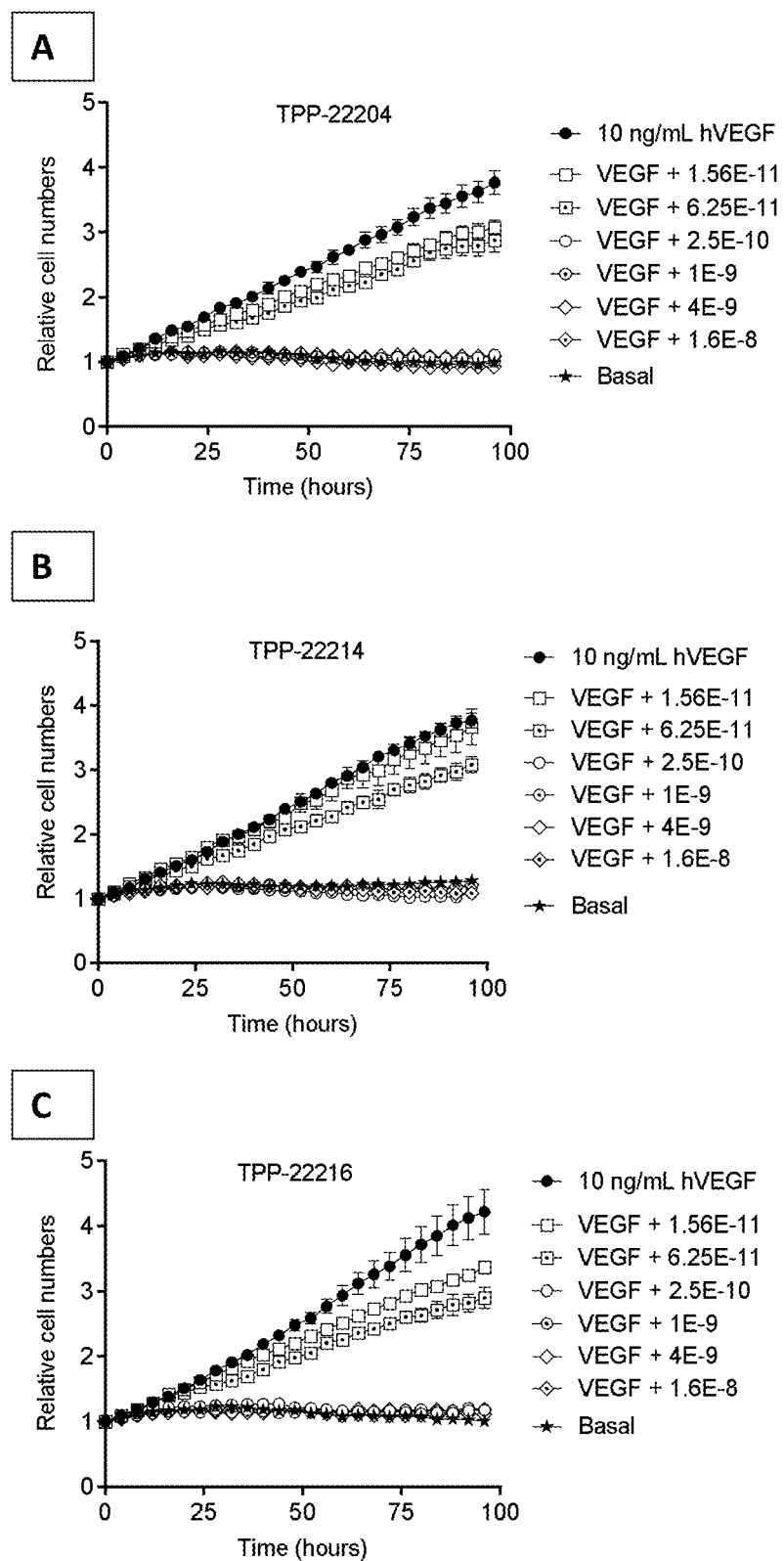
FIG.55 A-E

FIG. 55 A-E continued
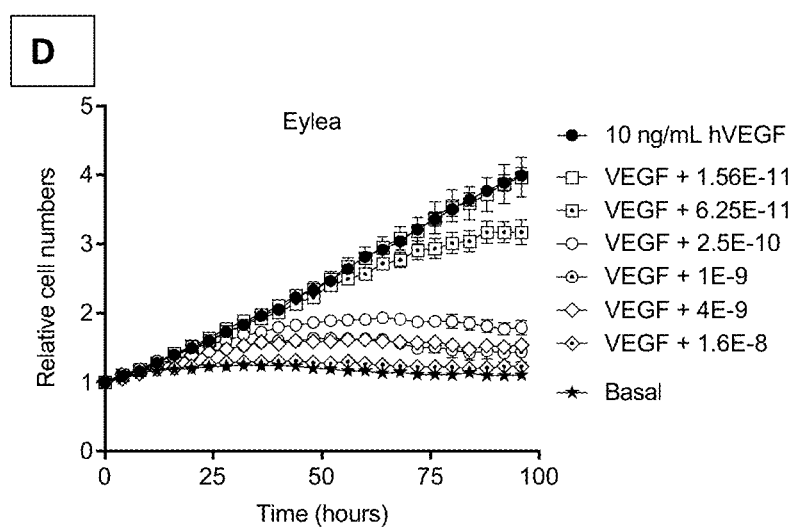
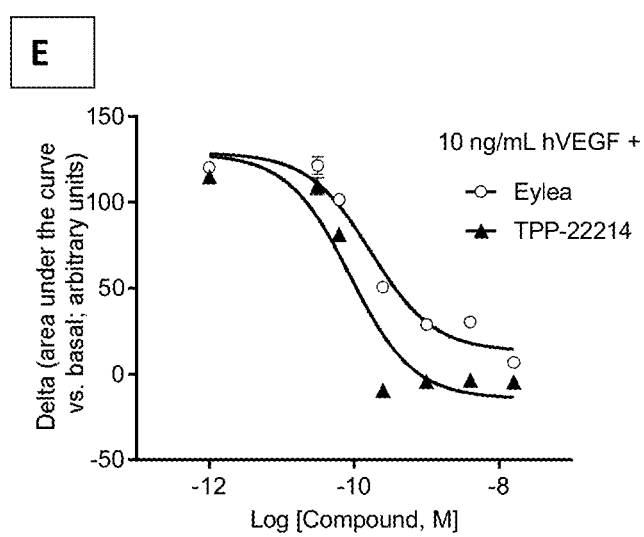

FIG.56 A-B
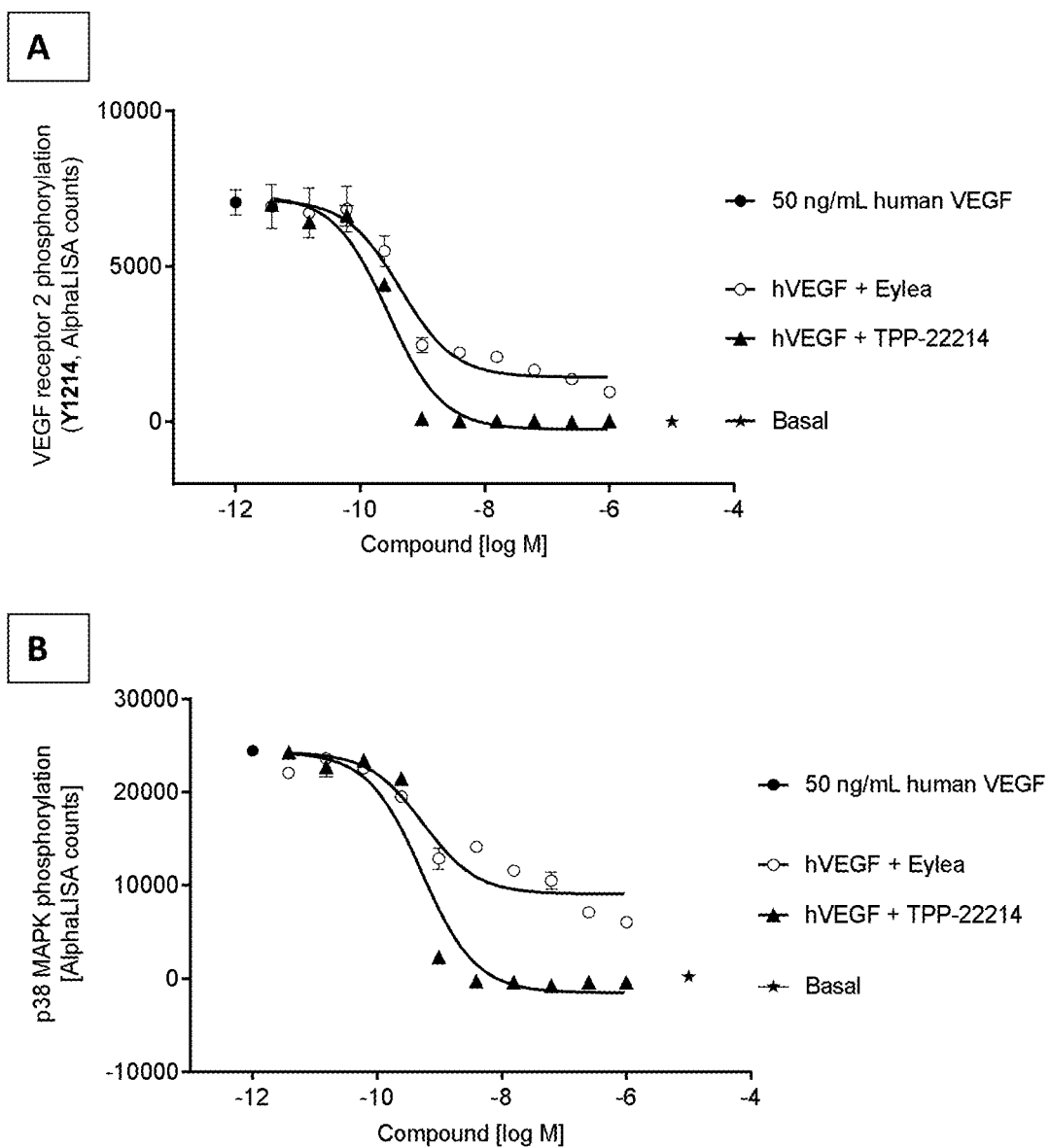

FIG.57 A-B
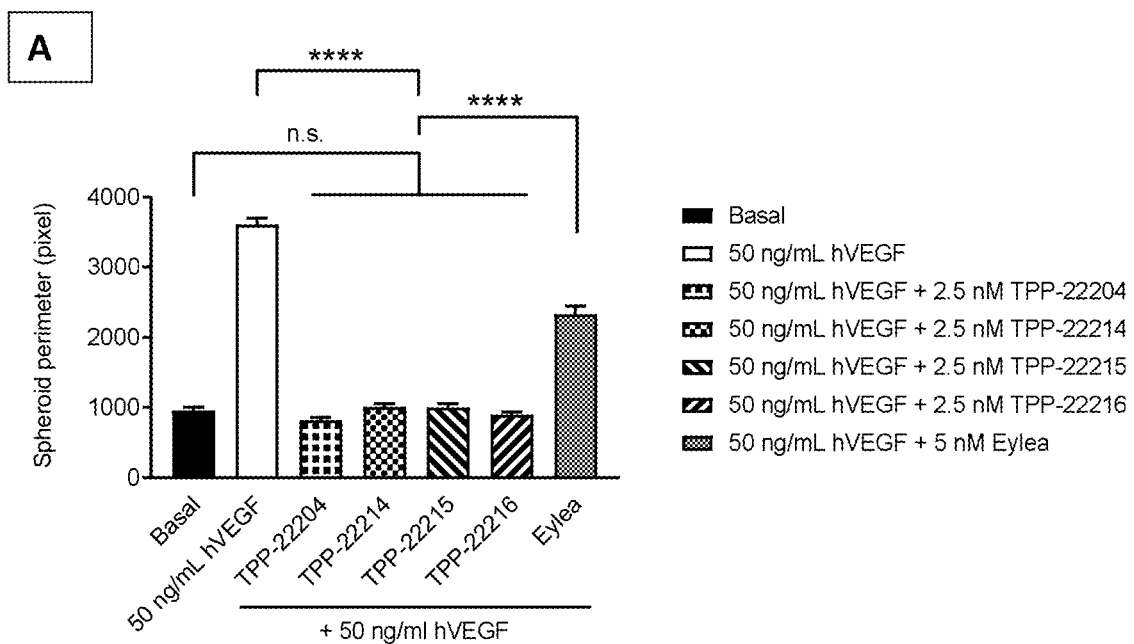
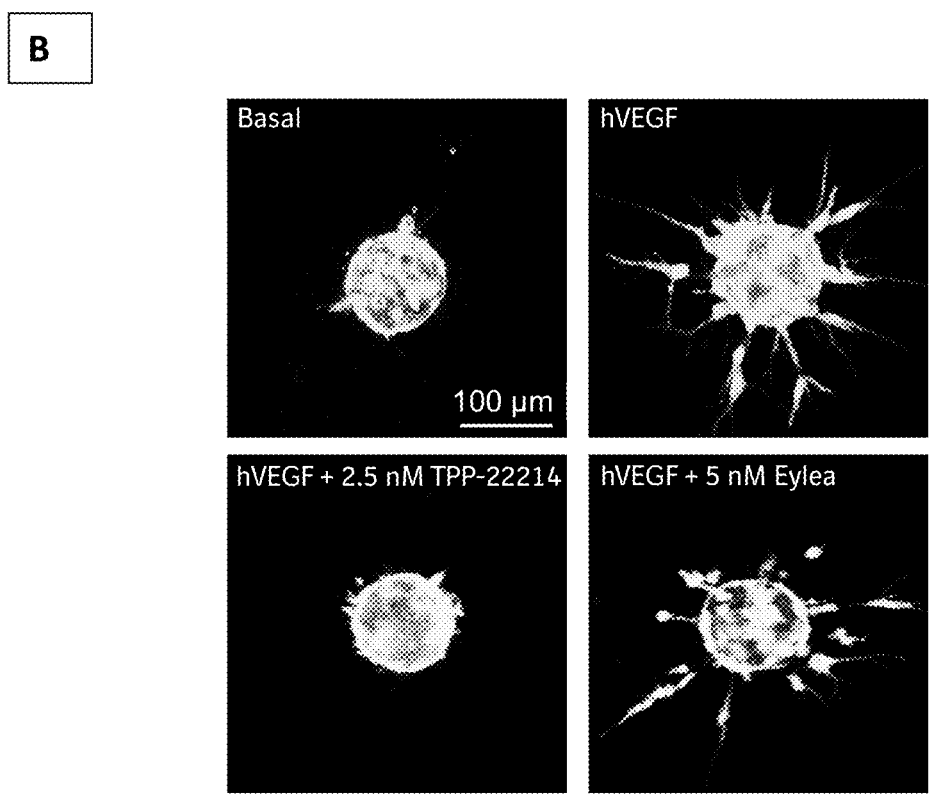

FIG.58 A-B
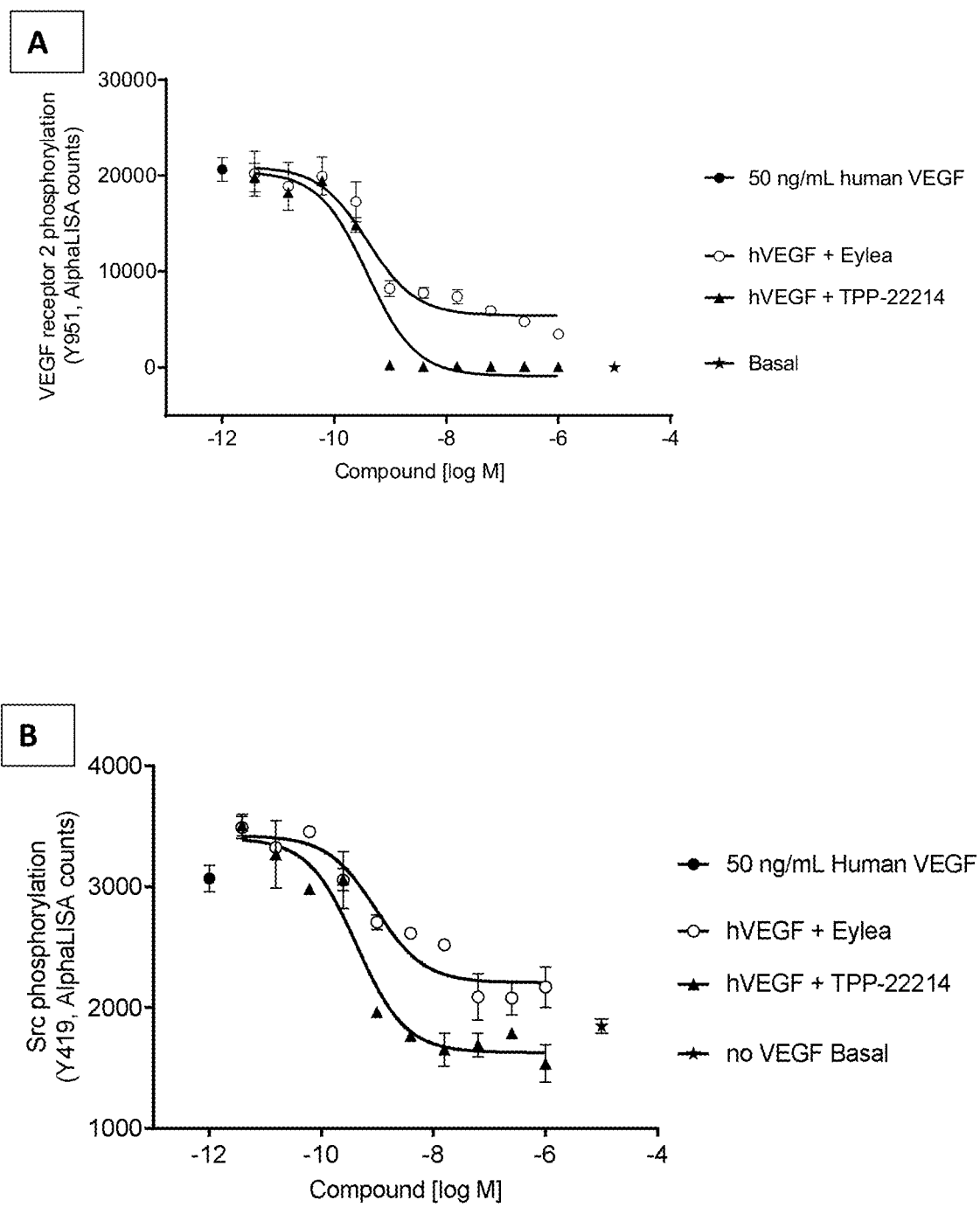

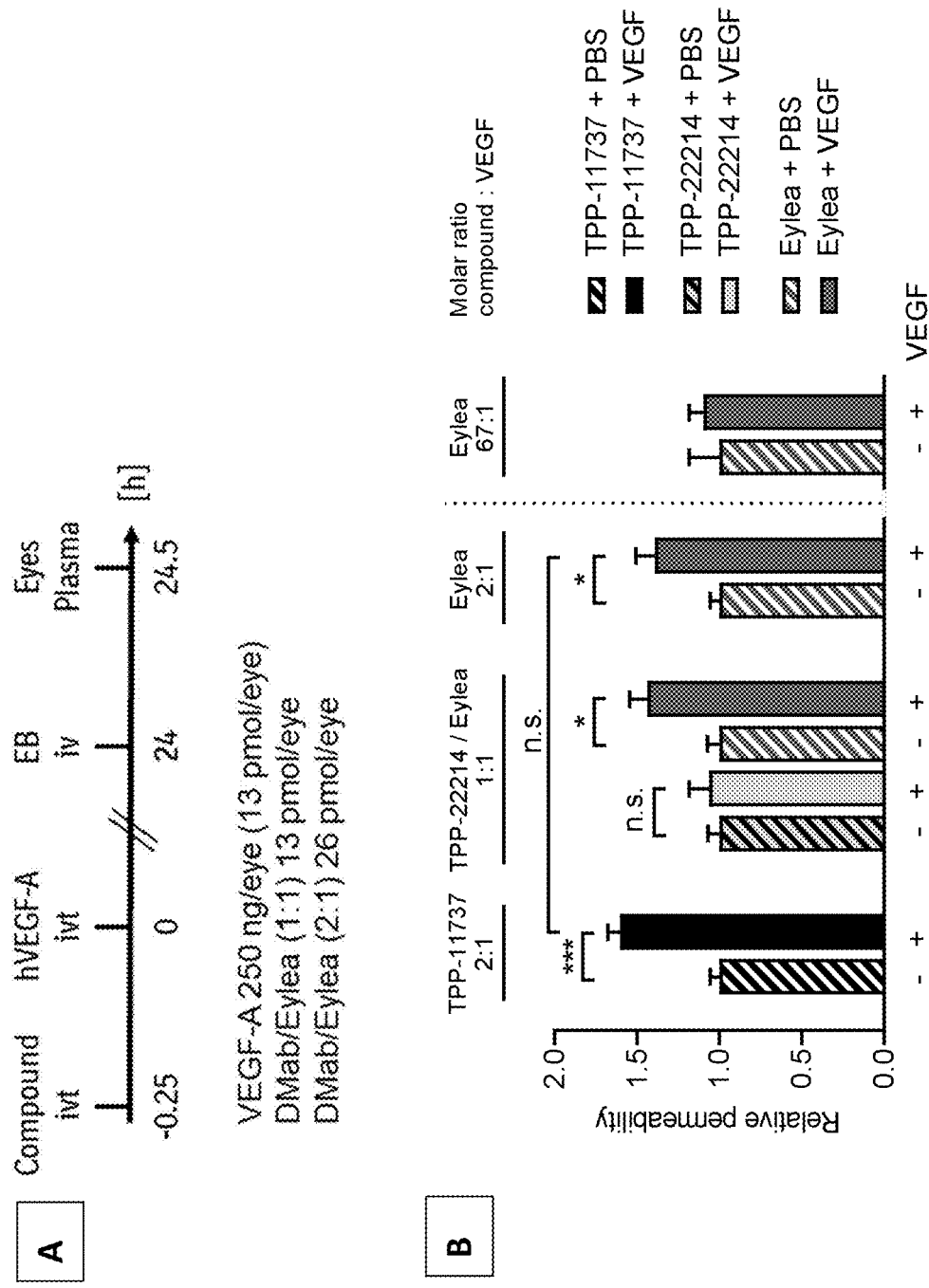
FIG. 59 A-B

FIG.60 A-B
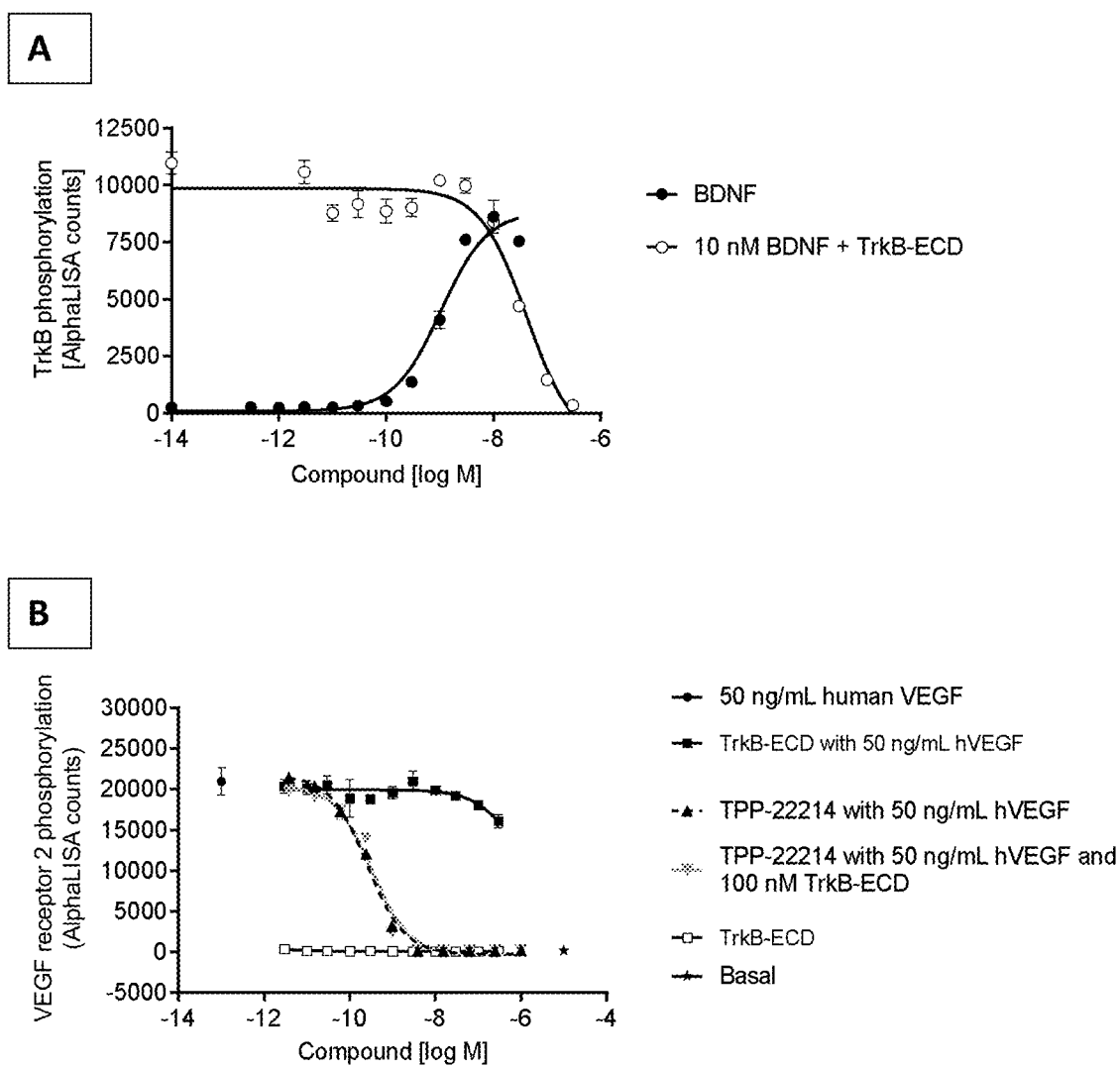

FIG.61 A-B
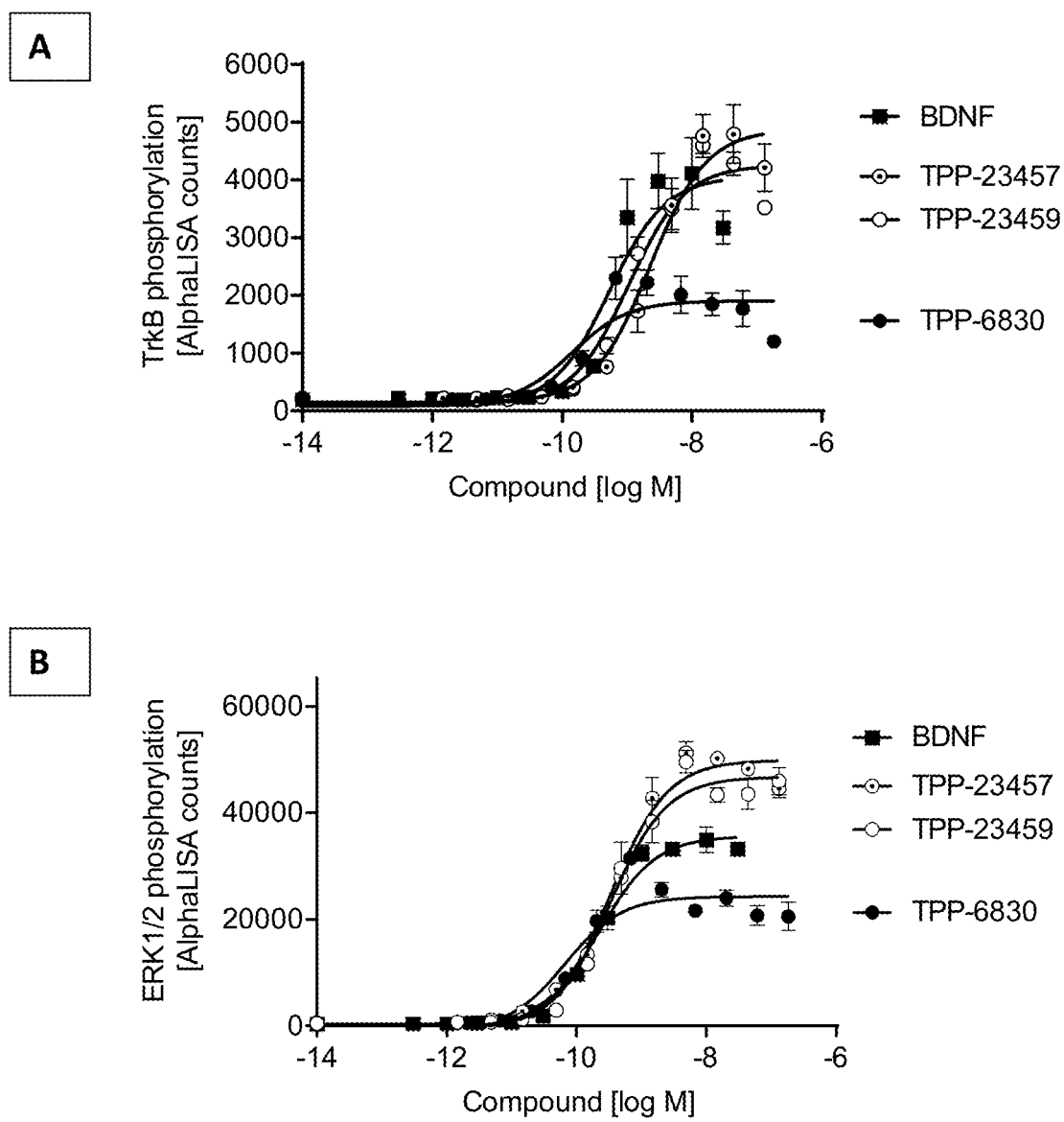

FIG.62 A-C
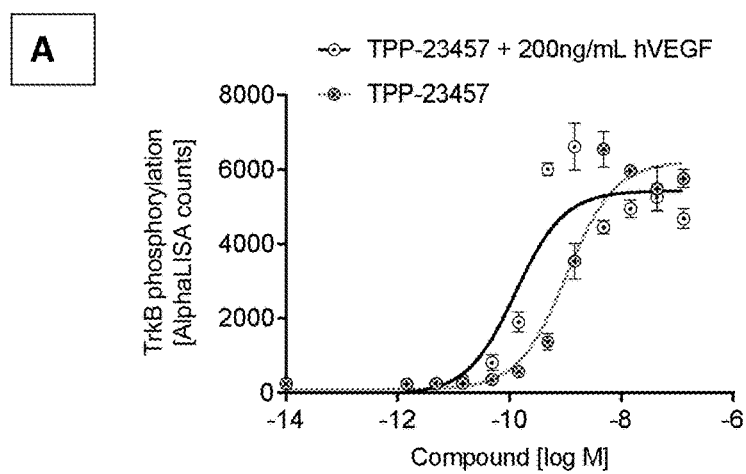
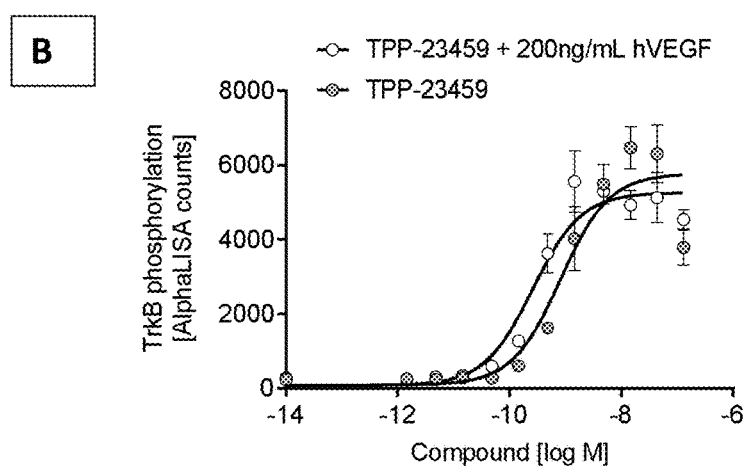
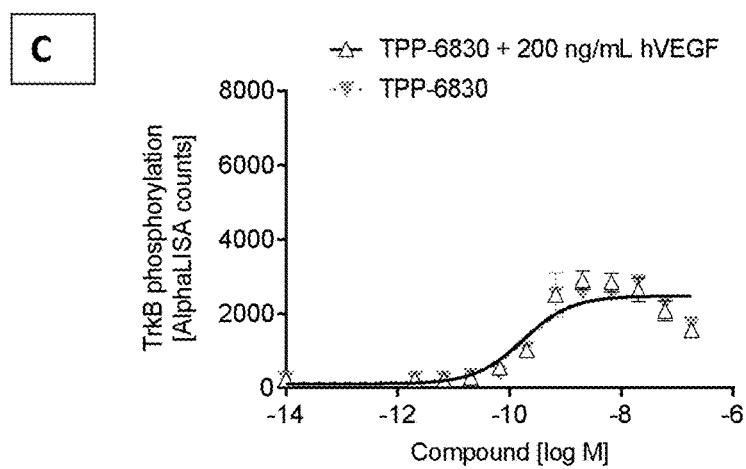

FIG.63 A-C
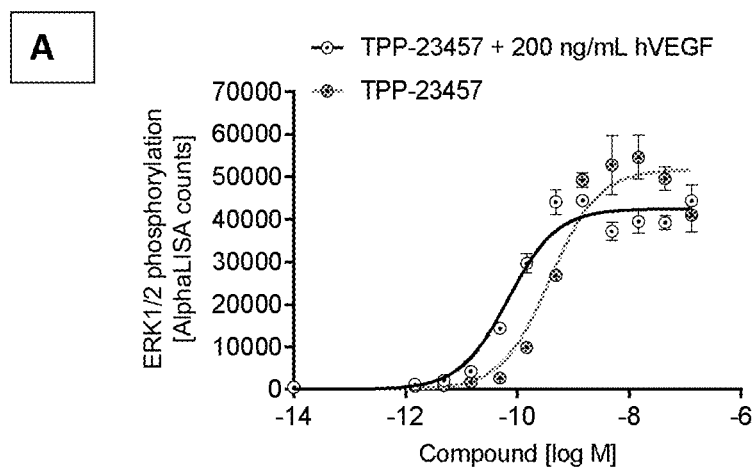
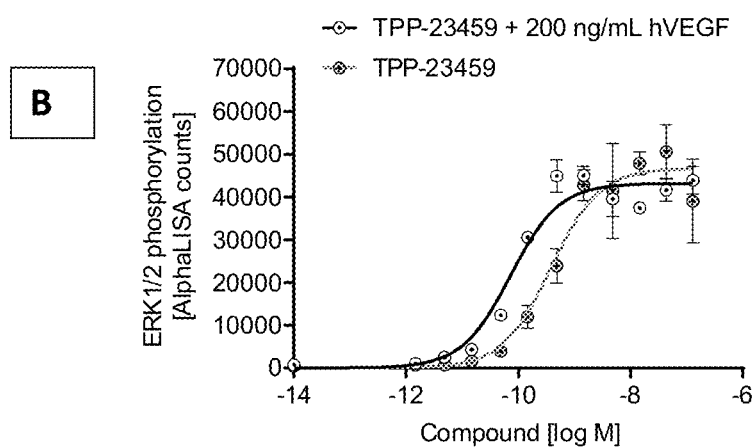
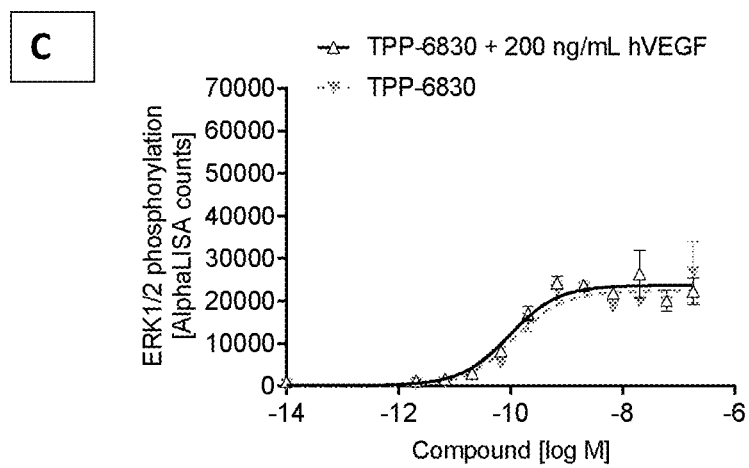

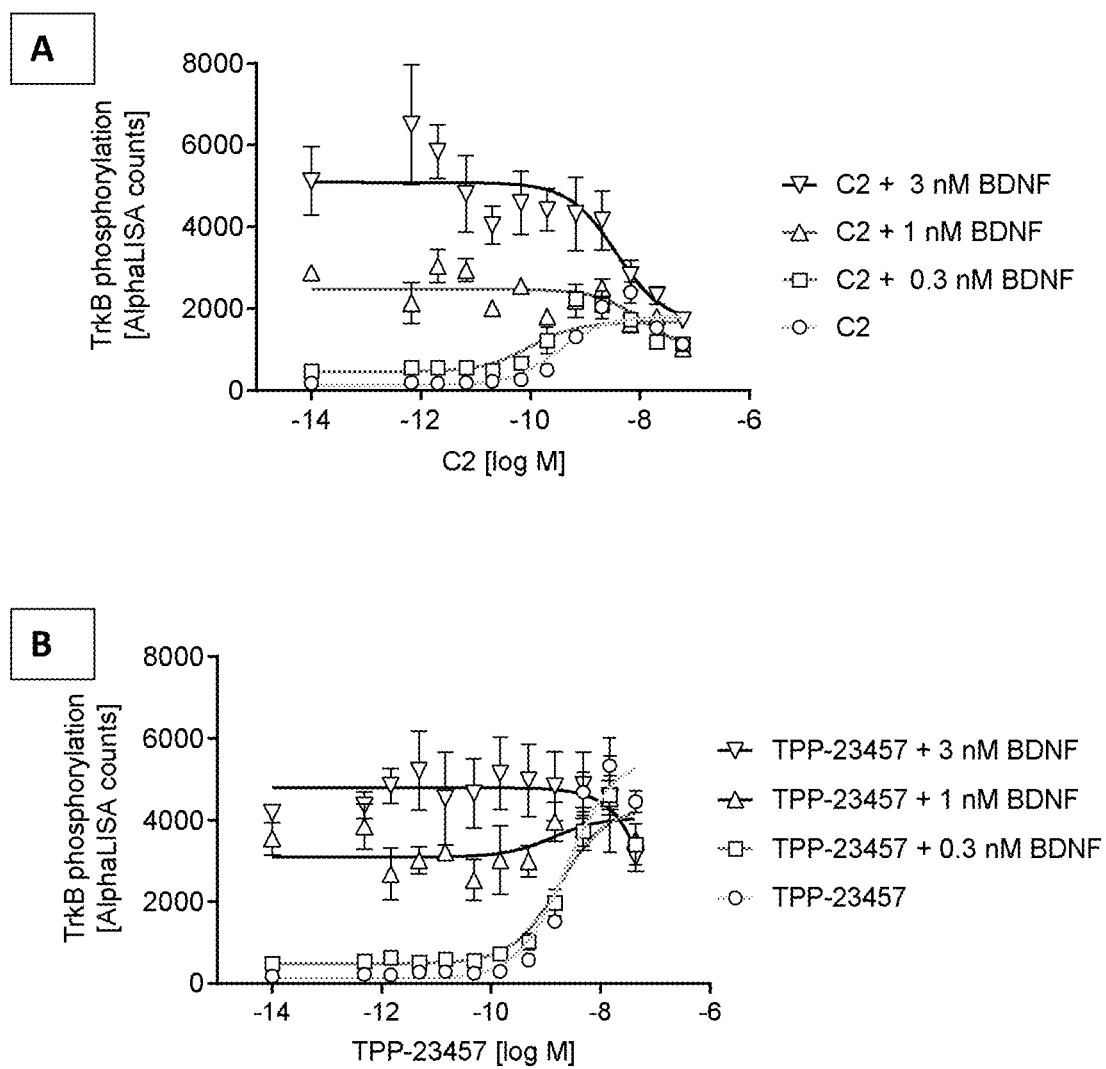
FIG.64 A-B

FIG.65 A-B
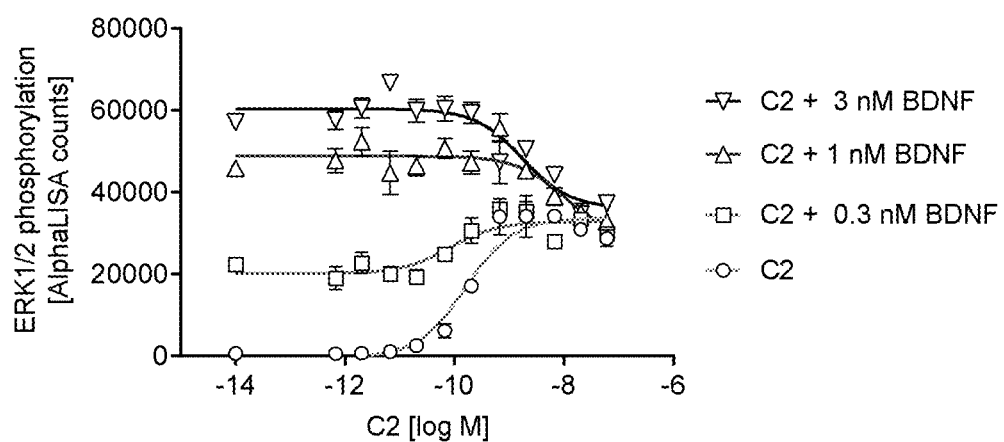
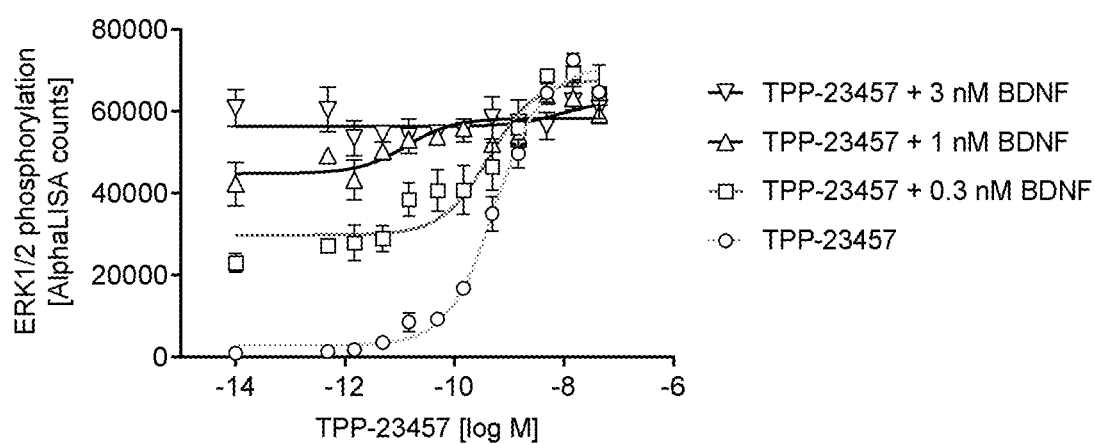

FIG.66 A-B
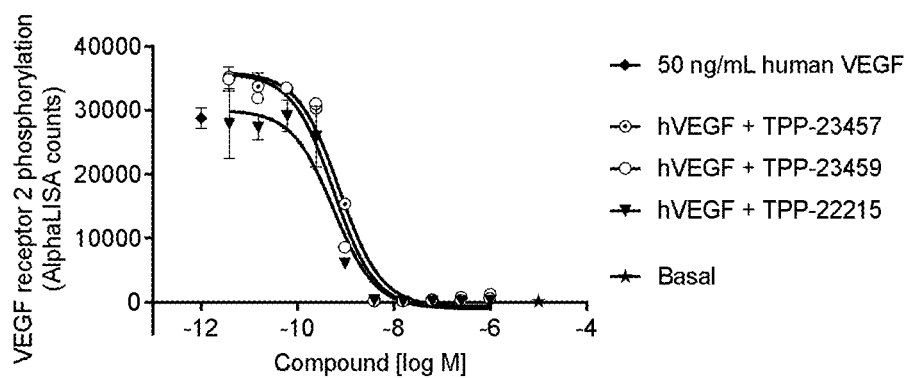
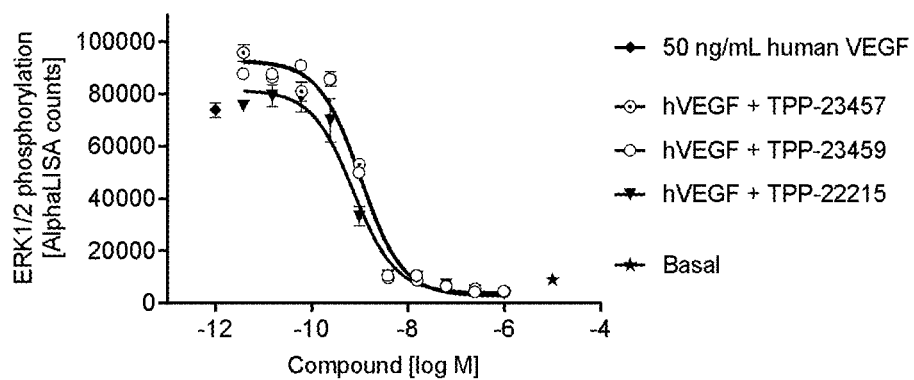

BISPECIFIC ANTI-VEGF AND ANTI-TrkB BINDING MOLECULES FOR THE TREATMENT OF EYE DISEASES

SEQUENCE LISTING

The instant application contains a Sequence Listing which has been submitted electronically in ASCII format and is hereby incorporated by reference in its entirety. Said ASCII copy, created on Oct. 11, 2021, is named 01-3412-US-1_SL.txt and is 689,828 bytes in size.

FIELD OF THE INVENTION

This invention relates to binding molecules that bind to Vascular Endothelial Growth Factor (VEGF) and Tropomyosin receptor kinase B (TrkB) and their use in medicine, pharmaceutical compositions comprising the same, and methods of using the same as agents for treatment and/or prevention of diseases of the eye.

BACKGROUND OF THE INVENTION

Macular degeneration and in particular age-related macular degeneration (AMD) is the leading cause of blindness in the developed world. Its advanced phases are divided into wet neovascular AMD and dry geographic atrophy (GA). wAMD is characterized by an increase in ocular neovascularization and vascular leakage as well as progressive neurodegeneration and photoreceptor loss. Anti-VEGF treatment is the current standard of care for this disease. Therapy typically consists of agents that target VEGF (Avastin® (bevacizumab), Lucentis® (ranibizumab), EYLEA® (aflibercept), and recently BEOVU® (brolucizumab-dbll)) that are dosed by injection to the back of the eye.

Although VEGF-scavenging reduces vascular leakage and thereby initially improves visual acuity, the retina remains in a compromised condition leading to further cell loss. While the past decade has seen breakthrough treatments for wAMD with intravitreal anti-VEGFs, no treatment options exist for geographic atrophy, a slow progressive disease eventually leading to blindness.

Within two years after wAMD diagnosis and despite successful anti-VEGF treatment, almost one third of the patients develop progressive geographic atrophy. It is the later stages that are associated with progressive visual impairment. Patients lose their visual acuity and independence. Their daily life is severely affected by not being able to drive, read, watch television, or recognize faces. wAMD patients are often undertreated in real-world settings and need to return to the office for frequent intravitreal injections.

No treatment is currently available for geographic atrophy of any type, including geographic atrophy developed during wAMD. Furthermore, there is some evidence that more frequent anti-VEGF treatment could be associated with higher rates of geographic atrophy development.

There is hence a high unmet need for providing new therapeutic biological molecules which may be used frequently in anti-VEGF treatment while at the same time alleviating the risk of concurrent geographic atrophy development.

SUMMARY OF THE INVENTION

The present invention is based on the concept of combining an antigen binding site that binds specifically to Vascular Endothelial Growth Factor (VEGF) with an antigen binding site that binds specifically to Tropomyosin receptor kinase B (TrkB) within a single binding molecule.

In a first aspect, the present invention relates to a binding molecule comprising at least one antigen binding site that binds specifically to Vascular Endothelial Growth Factor (VEGF) and at least one antigen binding site that binds specifically to Tropomyosin receptor kinase B (TrkB). In one embodiment relating to the first aspect, the binding molecule is bispecific and tetravalent. In a further embodiment relating to the binding molecule according to the first aspect or any of its embodiments, the at least one antigen binding site that binds specifically to VEGF is an immunoglobulin (Ig) molecule. In a further embodiment relating to the binding molecule according to the first aspect or any of its embodiments, the at least one antigen binding site that binds specifically to TrkB is fused to the C-terminus of the heavy chain of the Ig molecule. In a further embodiment relating to the binding molecule according to the first aspect or any of its embodiments, the at least one antigen binding site that binds specifically to TrkB comprises one or more scFv(s). In a further embodiment relating to the binding molecule according to the first aspect or any of its embodiments, the at least one antigen binding site that binds specifically to VEGF is an immunoglobulin (Ig) molecule and the at least one antigen binding site that binds specifically to TrkB comprises one or more scFv(s). In a related embodiment, the one or more scFv(s) have a VL-VH orientation from N- to C-terminus. In yet another related embodiment, the one or more scFv(s) is fused to the C-terminus of the heavy chain of the Ig molecule. In a further embodiment relating to the binding molecule according to the first aspect or any of its embodiments, the Ig molecule is a monoclonal antibody, a human monoclonal antibody, a humanized monoclonal antibody, a chimeric antibody, an (scFv)$_2$ or a fragment of an antibody such as a F(ab')2 fragment. In a further embodiment relating to the binding molecule according to the first aspect or any of its embodiments, the Ig molecule is an IgG or F(ab')2. In another embodiment relating to the binding molecule according to the first aspect or any of its embodiments, the one or more scFv(s) is fused to the Ig molecule by a peptide linker, preferably a peptide linker having a length of about 4 to 20 amino acids.

In a further embodiment relating to the binding molecule according to the first aspect or any of its embodiments, the antigen binding site that binds specifically to TrkB is selected from:

a) an antigen binding site comprising light chain CDRs comprising the amino acid sequences of SEQ ID NO:201 (CDR1), SEQ ID NO:202 (CDR2) and SEQ ID NO:203 (CDR3), and an antigen binding site comprising heavy chain CDRs comprising the amino acid sequences of SEQ ID NO:204 (CDR1), SEQ ID NO:205 (CDR2) and SEQ ID NO:206 (CDR3); or an antigen binding site comprising heavy chain CDRs comprising the amino acid sequences of SEQ ID NO:207 (CDR1), SEQ ID NO:208 (CDR2) and SEQ ID NO:209 (CDR3); or an antigen binding site comprising heavy chain CDRs comprising the amino acid sequences of SEQ ID NO:210 (CDR1), SEQ ID NO:211 (CDR2) and SEQ ID NO:212 (CDR3).

In a further embodiment relating to the binding molecule according to the first aspect or any of its embodiments, the antigen binding site that binds specifically to TrkB is selected from:
- a) an antigen binding site comprising a light chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:213 or 215, and a heavy chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:214 or 216.

In a further embodiment relating to the binding molecule according to the first aspect or any of its embodiments, the binding molecule comprises the amino acid sequence of SEQ ID NO:222, or the amino acid sequence of SEQ ID NO:223, or the amino acid sequence of SEQ ID NO:224, or the amino acid sequence of SEQ ID NO:225.

In a further embodiment relating to the binding molecule according to the first aspect or any of its embodiments, the antigen binding site that binds specifically to VEGF is selected from the group consisting of antigen binding sites a) to c):
- a) an antigen binding site comprising light chain CDRs comprising the amino acid sequences of SEQ ID NO:145 (CDR1), SEQ ID NO:146 (CDR2) and SEQ ID NO:147 (CDR3), and
  an antigen binding site comprising heavy chain CDRs comprising the amino acid sequences of SEQ ID NO:148 (CDR1), SEQ ID NO:149 (CDR2) and SEQ ID NO:150 (CDR3); or
  an antigen binding site comprising heavy chain CDRs comprising the amino acid sequences of SEQ ID NO:151 (CDR1), SEQ ID NO:152 (CDR2) and SEQ ID NO:153 (CDR3); or
  an antigen binding site comprising heavy chain CDRs comprising the amino acid sequences of SEQ ID NO:154 (CDR1), SEQ ID NO:155 (CDR2) and SEQ ID NO:156 (CDR3);
- b) an antigen binding site comprising light chain CDRs comprising the amino acid sequences of SEQ ID NO:157 (CDR1), SEQ ID NO:158 (CDR2) and SEQ ID NO:159 (CDR3), and
  an antigen binding site comprising heavy chain CDRs comprising the amino acid sequences of SEQ ID NO:160 (CDR1), SEQ ID NO:161 (CDR2) and SEQ ID NO:162 (CDR3); or
  an antigen binding site comprising heavy chain CDRs comprising the amino acid sequences of SEQ ID NO:163 (CDR1), SEQ ID NO:164 (CDR2) and SEQ ID NO:165 (CDR3); or
  an antigen binding site comprising heavy chain CDRs comprising the amino acid sequences of SEQ ID NO:166 (CDR1), SEQ ID NO:167 (CDR2) and SEQ ID NO:168 (CDR3);
- c) an antigen binding site comprising light chain CDRs comprising the amino acid sequences of SEQ ID NO:169 (CDR1), SEQ ID NO:170 (CDR2) and SEQ ID NO:171 (CDR3), and
  an antigen binding site comprising heavy chain CDRs comprising the amino acid sequences of SEQ ID NO:172 (CDR1), SEQ ID NO:173 (CDR2) and SEQ ID NO:174 (CDR3); or
  an antigen binding site comprising heavy chain CDRs comprising the amino acid sequences of SEQ ID NO:175 (CDR1), SEQ ID NO:176 (CDR2) and SEQ ID NO:177 (CDR3); or
  an antigen binding site comprising heavy chain CDRs comprising the amino acid sequences of SEQ ID NO:178 (CDR1), SEQ ID NO:179 (CDR2) and SEQ ID NO:180 (CDR3).

In a further embodiment relating to the binding molecule according to the first aspect or any of its embodiments, the antigen binding site that binds specifically to VEGF is selected from the group consisting of antigen binding sites a) to d):
- a) an antigen binding site comprising a light chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:181 and a heavy chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:182;
- b) an antigen binding site comprising a light chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:183 and a heavy chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:184;
- c) an antigen binding site comprising a light chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:189 and a heavy chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:190, 191, 192 or 194;
- d) an antigen binding site comprising a light chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:193 and a heavy chain variable domain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:190, 191, 192 or 194.

In a further embodiment relating to the binding molecule according to the first aspect or any of its embodiments, the antigen binding site that binds specifically to VEGF is selected from the group consisting of antigen binding sites a) to d):
- a) an antigen binding site comprising a light chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:185 and a heavy chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:186;

b) an antigen binding site comprising a light chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:187 and a heavy chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:188;

c) an antigen binding site comprising a light chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:195 and a heavy chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:196, 197, 198 or 200;

d) an antigen binding site comprising a light chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:199 and a heavy chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:196, 197, 198 or 200.

In a second aspect the invention relates to a binding molecule comprising a light chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141 or 143, and a heavy chain comprising an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, or 144.

In a third aspect the invention relates to a binding molecule comprising: (i) a light chain comprising the amino acid sequence of SEQ ID NO:41 and a heavy chain comprising the amino acid sequence of SEQ ID NO:42, or (ii) a light chain comprising the amino acid sequence of SEQ ID NO:43 and a heavy chain comprising the amino acid sequence of SEQ ID NO:44, or (iii) a light chain comprising the amino acid sequence of SEQ ID NO:45 and a heavy chain comprising the amino acid sequence of SEQ ID NO:46, or (iv) a light chain comprising the amino acid sequence of SEQ ID NO:47 and a heavy chain comprising the amino acid sequence of SEQ ID NO:48, or (v) a light chain comprising the amino acid sequence of SEQ ID NO:49 and a heavy chain comprising the amino acid sequence of SEQ ID NO:50, or (vi) a light chain comprising the amino acid sequence of SEQ ID NO:51 and a heavy chain comprising the amino acid sequence of SEQ ID NO:52, or (vii) a light chain comprising the amino acid sequence of SEQ ID NO:53 and a heavy chain comprising the amino acid sequence of SEQ ID NO:54, or (viii) a light chain comprising the amino acid sequence of SEQ ID NO:55 and a heavy chain comprising the amino acid sequence of SEQ ID NO:56, or (ix) a light chain comprising the amino acid sequence of SEQ ID NO:57 and a heavy chain comprising the amino acid sequence of SEQ ID NO:58, or (x) a light chain comprising the amino acid sequence of SEQ ID NO:59 and a heavy chain comprising the amino acid sequence of SEQ ID NO:60, or (xi) a light chain comprising the amino acid sequence of SEQ ID NO:61 and a heavy chain comprising the amino acid sequence of SEQ ID NO:62, or (xii) a light chain comprising the amino acid sequence of SEQ ID NO:63 and a heavy chain comprising the amino acid sequence of SEQ ID NO:64, or (xiii) a light chain comprising the amino acid sequence of SEQ ID NO:65 and a heavy chain comprising the amino acid sequence of SEQ ID NO:66, or (xiv) a light chain comprising the amino acid sequence of SEQ ID NO:67 and a heavy chain comprising the amino acid sequence of SEQ ID NO:68, or (xv) a light chain comprising the amino acid sequence of SEQ ID NO:69 and a heavy chain comprising the amino acid sequence of SEQ ID NO:70, or (xvi) a light chain comprising the amino acid sequence of SEQ ID NO:71 and a heavy chain comprising the amino acid sequence of SEQ ID NO:72, or (xvii) a light chain comprising the amino acid sequence of SEQ ID NO:73 and a heavy chain comprising the amino acid sequence of SEQ ID NO:74, or (xviii) a light chain comprising the amino acid sequence of SEQ ID NO:75 and a heavy chain comprising the amino acid sequence of SEQ ID NO:76, or (xix) a light chain comprising the amino acid sequence of SEQ ID NO:77 and a heavy chain comprising the amino acid sequence of SEQ ID NO:78, or (xx) a light chain comprising the amino acid sequence of SEQ ID NO:79 and a heavy chain comprising the amino acid sequence of SEQ ID NO:80, or (xxi) a light chain comprising the amino acid sequence of SEQ ID NO:81 and a heavy chain comprising the amino acid sequence of SEQ ID NO:82, or (xxii) a light chain comprising the amino acid sequence of SEQ ID NO:83 and a heavy chain comprising the amino acid sequence of SEQ ID NO:84, or (xxiii) a light chain comprising the amino acid sequence of SEQ ID NO:85 and a heavy chain comprising the amino acid sequence of SEQ ID NO:86, or (xxiv) a light chain comprising the amino acid sequence of SEQ ID NO:87 and a heavy chain comprising the amino acid sequence of SEQ ID NO:88, or (xxv) a light chain comprising the amino acid sequence of SEQ ID NO:89 and a heavy chain comprising the amino acid sequence of SEQ ID NO:90, or (xxvi) a light chain comprising the amino acid sequence of SEQ ID NO:91 and a heavy chain comprising the amino acid sequence of SEQ ID NO:92, or (xxvii) a light chain comprising the amino acid sequence of SEQ ID NO:93 and a heavy chain comprising the amino acid sequence of SEQ ID NO:94, or (xxviii) a light chain comprising the amino acid sequence of SEQ ID NO:95 and a heavy chain comprising the amino acid sequence of SEQ ID NO:96, or (xxix) a light chain comprising the amino acid sequence of SEQ ID NO:97 and a heavy chain comprising the amino acid sequence of SEQ ID NO:98, or (xxx) a light chain comprising the amino acid sequence of SEQ ID NO:99 and a heavy chain comprising the amino acid sequence of SEQ ID NO:100, or (xxxi) a light chain comprising the amino acid sequence of SEQ ID NO:101 and a heavy chain comprising the amino acid sequence of SEQ ID NO:102, or (xxxii) a light chain comprising the amino acid sequence of SEQ ID NO:103 and a heavy chain comprising the amino acid sequence of SEQ ID NO:104, or (xxxiii) a light chain comprising the amino acid sequence of SEQ ID NO:105 and a heavy chain comprising the amino acid sequence of SEQ ID NO:106, or (xxxiv) a light chain comprising the amino acid sequence of SEQ ID NO:107 and a heavy chain comprising the amino acid sequence of SEQ ID NO:108, or (xxxv) a light chain comprising the amino acid sequence of SEQ ID NO:109 and a heavy chain comprising the amino acid sequence of SEQ ID NO:110, or (xxxvi) a light chain comprising the amino acid sequence of SEQ ID NO:111 and a heavy chain comprising the amino acid sequence of SEQ ID NO:112, or (xxxvii) a light chain comprising the amino acid sequence of SEQ ID NO:113 and a heavy chain comprising the amino acid sequence of SEQ ID NO:114, or (xxxviii) a light chain comprising the amino acid sequence of SEQ ID NO:115 and a heavy chain comprising the amino acid sequence of SEQ ID NO:116, or (xxxix) a light chain comprising the amino acid sequence of SEQ ID NO:117 and a heavy chain comprising the amino acid sequence of SEQ ID NO:118, or (xl) a light chain comprising the amino acid sequence of SEQ ID NO:119 and a heavy chain comprising the amino acid sequence of SEQ ID NO:120, or (xli) a light chain comprising the amino acid sequence of SEQ ID NO:121 and a heavy chain comprising the amino acid sequence of SEQ ID NO:122, or (xlii) a light chain comprising the amino acid sequence of SEQ ID NO:123 and a heavy chain comprising the amino acid sequence of SEQ ID NO:124, or (xliii) a light chain comprising the amino acid sequence of SEQ ID NO:125 and a heavy chain comprising the amino acid sequence of SEQ ID NO:126, or (xliv) a light chain comprising the amino acid sequence of SEQ ID NO:127 and a heavy chain comprising the amino acid sequence of SEQ ID NO:128, or (xlv) a light chain comprising the amino acid sequence of SEQ ID NO:129 and a heavy chain comprising the amino acid sequence of SEQ ID NO:130, or (xlvi) a light chain comprising the amino acid sequence of SEQ ID NO:131 and a heavy chain comprising the amino acid sequence of SEQ ID NO:132, or (xlvii) a light chain comprising the amino acid sequence of SEQ ID NO:133 and a heavy chain comprising the amino acid sequence of SEQ ID NO:134, or (xlviii) a light chain comprising the amino acid sequence of SEQ ID NO:135 and a heavy chain comprising the amino acid sequence of SEQ ID NO:136, or (xlix) a light chain comprising the amino acid sequence of SEQ ID NO:137 and a heavy chain comprising the amino acid sequence of SEQ ID NO:138, or (l) a light chain comprising the amino acid sequence of SEQ ID NO:139 and a heavy chain comprising the amino acid sequence of SEQ ID NO:140, or (li) a light chain comprising the amino acid sequence of SEQ ID NO:141 and a heavy chain comprising the amino acid sequence of SEQ ID NO:142, or (lii) a light chain comprising the amino acid sequence of SEQ ID NO:143 and a heavy chain comprising the amino acid sequence of SEQ ID NO:144.

In a fourth aspect the invention relates to a TrkB binding molecule comprising or consisting of two scFv's, wherein each scFv binds specifically to TrkB.

In a further embodiment relating to the fourth aspect the TrkB binding molecule further comprises an Ig molecule.

In a further embodiment relating to the fourth aspect or any of its embodiments the Ig molecule is a monoclonal antibody, a human monoclonal antibody, a humanized monoclonal antibody, a chimeric antibody, a fragment of an antibody, such as a Fv, Fab, Fab', or F(ab')2 fragment, a single chain antibody, such as a single chain variable fragment (scFv), a Small Modular Immunopharmaceutical (SMIP), a domain antibody, a nanobody, or a diabody.

In a further embodiment relating to the fourth aspect or any of its embodiments each scFv is fused to the C-terminus of the heavy chain of the Ig molecule. In a further embodiment relating to the fourth aspect or any of its embodiments the Ig molecule is an IgG, F(ab), F(ab')2. In a further embodiment relating to the fourth aspect or any of its embodiments the Ig molecule comprises or consists of an Fc region. In a further embodiment relating to the fourth aspect or any of its embodiments, the TrkB binding molecule is bispecific and tetravalent.

In a fifth aspect the invention relates to an scFv binding specifically to TrkB comprising (i) a light chain variable domain comprising the amino acid sequence of SEQ ID NO:213 and a heavy chain variable domain comprising the amino acid sequence of SEQ ID NO:214 or (ii) a light chain variable domain comprising the amino acid sequence of SEQ ID NO:215 and a heavy chain variable domain comprising the amino acid sequence of SEQ ID NO:216.

In a further embodiment relating to the fifth aspect, the scFv comprises the amino acid sequence of SEQ ID NO:222, or the amino acid sequence of SEQ ID NO:223, or the amino acid sequence of SEQ ID NO:224, or the amino acid sequence of SEQ ID NO:225.

In a sixth aspect the invention relates to an antibody molecule binding specifically to VEGF comprising:
 (i) a light chain variable domain comprising the amino acid sequence of SEQ ID NO:189, and
  a heavy chain variable domain comprising the amino acid sequence of SEQ ID NO:191; or
  a heavy chain variable domain comprising the amino acid sequence of SEQ ID NO:192; or
  a heavy chain variable domain comprising the amino acid sequence of SEQ ID NO:194;
 (ii) a heavy chain variable domain comprising the amino acid sequence of SEQ ID NO:190, and
  a light chain variable domain comprising the amino acid sequence of SEQ ID NO:192; or
  a light chain variable domain comprising the amino acid sequence of SEQ ID NO:193.

In a further embodiment relating to the sixth aspect, the antibody molecule comprises:
 a light chain comprising the amino acid sequence of SEQ ID NO:195 or 199, and a heavy chain comprising the amino acid sequence of SEQ ID NO:196, 197, 198 or 200.

In a seventh aspect, the invention relates to an isolated nucleic acid molecule encoding (i) the heavy chain or heavy chain variable domain, and/or (ii) the light chain or light chain variable domain of a binding molecule of any one of the aforementioned aspects and embodiments.

In an eighth aspect, the invention relates to an isolated nucleic acid molecule encoding (i) the heavy chain or heavy chain variable domain, and/or (ii) the light chain or light chain variable domain of a TrkB binding molecule according to any one of the aforementioned aspects and embodiments In a ninth aspect, the invention relates to an isolated nucleic acid molecule encoding (i) the heavy chain variable domain, and/or (ii) the light chain variable domain of an scFv according to any one of the aforementioned aspects and embodiments.

In an tenth aspect, the invention relates to an isolated nucleic acid molecule encoding (i) the heavy chain or heavy chain variable domain, and/or (ii) the light chain or light chain variable domain of an antibody molecule according to any one of the aforementioned aspects and embodiments.

In a eleventh aspect, the invention relates to a viral vector comprising the isolated nucleic acid molecule according to seventh, eighth, ninth or tenth aspect.

In a twelfth aspect, the invention relates to an expression vector comprising a nucleic acid molecule according to the eleventh aspect.

In an thirteenth aspect, the invention relates to a host cell transfected with an expression vector according to the twelfth aspect.

In a fourteenth aspect, the invention relates to a method of manufacturing a binding molecule, a TrkB binding molecule, a scFv, or an antibody molecule according to any of the aforementioned aspects and embodiments, comprising
  (a) cultivating the host cell of the thirteenth aspect under conditions allowing expression of the molecule; and,
  (b) recovering the molecule; and optionally
  (c) further purifying and/or modifying and/or formulating the molecule.

In a fifteenth aspect, the invention relates to the binding molecule, a TrkB binding molecule, the scFv, or the antibody molecule according to any of the aforementioned aspects and embodiments for use in medicine.

In an embodiment relating to the fifteenth aspect, the invention relates to the binding molecule, the TrkB binding molecule, the scFv, or the antibody molecule for the use according to the fifteenth aspect, wherein the use is the treatment of eye or retinal or neurodegenerative diseases.

In a further embodiment relating to the fifteenth aspect, the invention relates to the binding molecule, the TrkB binding molecule, the scFv, or the antibody molecule for the use according to the fifteenth aspect, wherein the use is for the treatment of neural/neuronal eye or retinal diseases.

In another embodiment relating to the fifteenth aspect, the invention relates to the binding molecule, the TrkB binding molecule, the scFv, or the antibody molecule for the use according to the fifteenth aspect, wherein the use is for the treatment of macular degeneration, age-related macular degeneration, diabetic retinopathy, diabetic macular edema, retinitis pigmentosa, inherited retinal dystrophy, inherited macular dystrophy, myopic degeneration, geographic atrophy, retinal artery occlusions, endophthalmitis, uveitis, cystoid macular edema, choroidal neovascular membrane secondary to any retinal diseases, optic neuropathies, glaucoma, retinal detachment, toxic retinopathy, radiation retinopathy, and traumatic retinopathy, prodromal and mild-to-moderate alzheimer's diseases, delaying disease progression of patients with Alzheimer's disease, Huntington's disease, Parkinson's disease, major depressive disorder, schizophrenia, cognitive impairment associated with schizophrenia, prevention of first-episode psychosis in individuals with attenuated psychosis syndrome, prevention of relapse in patients with schizophrenia, treatment-resistant depression, hyperphagia, obesity or metabolic syndrome.

In an embodiment relating to the fifteenth aspect, the invention relates to the binding molecule, the TrkB binding molecule, the scFv, or the antibody molecule for the use according to the fifteenth aspect, wherein the use is for the treatment of macular degeneration and in particular wet age-related macular degeneration (wAMD).

In an embodiment relating to the fifteenth aspect, the invention relates to the binding molecule, the TrkB binding molecule, the scFv, or the antibody molecule for the use according to the fifteenth aspect, wherein the use is for the treatment of retinal vein occlusion (RVO).

In an embodiment relating to the fifteenth aspect, the invention relates to the binding molecule, the TrkB binding molecule, the scFv, or the antibody molecule for the use according to the fifteenth aspect, wherein the use is for the treatment and/or prevention of geographic atrophy.

In a sixteenth aspect, the invention relates to a pharmaceutical composition comprising a pharmaceutically acceptable carrier and the binding molecule, the TrkB binding molecule, the scFv, or the antibody molecule according to any of the aforementioned aspects and embodiments.

In a seventeenth aspect, the invention relates to a method of treating or preventing an eye or retinal or neurodegenerative disease comprising administering to a patient in need thereof a therapeutically effective amount of the binding molecule, the TrkB binding molecule, the scFv, or the antibody molecule according to any of the aforementioned aspects and embodiments.

In an eighteenth aspect, the invention relates to the use of the binding molecule, the TrkB binding molecule, the scFv or the antibody molecule according to any of the aforementioned aspects and embodiments for preparing a pharmaceutical composition for treating or preventing an eye or retinal or neurodegenerative diseases.

BRIEF DESCRIPTION OF THE FIGURES

FIG. 2 A-B: (A) TrkB phosphorylation (Y706/707) or (B) ERK1/2 phosphorylation (T202/Y204—ERK1) (T185/Y187—ERK2) was measured in CHO cells stably expressing human TrkB after incubation with growing concentrations of the indicated molecules. Data represent mean+/−SEM.

FIG. 3 A-D: TrkB phosphorylation (Y706/707) was measured in CHO cells stably expressing (A) cyno TrkB, (B) rabbit TrkB, (C) rat TrkB or (D) mouse TrkB after incubation with growing concentrations of the indicated molecules. Data represent mean+/−SEM.

FIG. 4 A-C: Trk phosphorylation (Y706/707) was measured in CHO cells stably expressing (A) human TrkA, (B) human TrkB, or (C) human TrkC after incubation with growing concentrations of the indicated molecules. The natural ligands NGF for TrkA, BDNF for TrkB, and NT-3 for TrkC were used as controls. Data represent mean+/−SEM.

FIG. 5 A-B: (A) CHO cells stably expressing human TrkB were incubated with the indicated concentrations of the natural TrkB ligand BDNF (in duplicate), 1 nM BDNF with the indicated concentrations of the agonistic TrkB antibody C2 (in triplicate) or 1 nM BDNF with the indicated concentrations of the Doppelmab TPP-11736 (in triplicate). (B) TrkB internalization was assessed by immunofluorescence staining of surface TrkB receptors followed by confocal microscopy analysis. Dark and light fields of the heatmap represent high and low percentage of cells above fluorescence threshold, respectively.

FIG. 11 A-E: Human retinal microvascular endothelial cells (HRMECs) were starved and then incubated with 10 ng/mL human VEGF with or without pre-incubation with growing concentrations of the indicated molecules: (A) TPP-11735, (B) TPP-11736, (C) EYLEA® (aflibercept), (D) TPP-11737, (E) TPP-11738. Molecule concentrations are given in mol/L. VEGF-A scavenging was assessed by image-based quantification of HRMEC cell numbers. Relative cell numbers are shown. Cell numbers at t=0 were set to one. Non-stimulated cells served as control (Basal). Data represent mean+/−SEM.

FIG. 26 A-B: TrkB phosphorylation (Y706/707) was measured in CHO cells stably expressing (A) cyno TrkB or (B) rat TrkB after incubation with growing concentrations of the indicated molecules of the second series. Data represent mean+/−SEM.

FIG. 27 A-C: TrkB phosphorylation (Y706/707) was measured in CHO cells stably expressing human TrkB after incubation with growing concentrations of Doppelmabs (A) TPP-14940, (B) TPP-14941 or (C) C2 antibody with or without pre-incubation with 200 ng/mL human VEGF-A. Data represent the mean+/−SEM.

FIG. 28 A-C: ERK1/2 phosphorylation (T202/Y204—ERK1) (T185/Y187—ERK2) was measured in CHO cells stably expressing human TrkB after incubation with growing concentrations of Doppelmabs (A) TPP-14940, (B) TPP-14941 or (C) C2 antibody with or without pre-incubation with 200 ng/mL human VEGF-A. Data represent the mean+/−SEM.

FIG. 29 A-B: (A) TrkB phosphorylation (Y706/707) or (B) ERK1/2 phosphorylation (T202/Y204—ERK1) (T185/Y187—ERK2) was measured in CHO cells stably expressing human TrkB after incubation with growing concentrations of either human VEGF-A or with growing concentrations of BDNF alone, or growing concentrations of BDNF with a fixed concentration of 200 ng/mL hVEGF. Data represent the mean+/−SEM.

FIG. 30 A-C: TrkB phosphorylation (Y706/707) was measured in CHO cells stably expressing cyno TrkB after incubation with growing concentrations of Doppelmabs (A) TPP-14940, (B) TPP-14941 or (C) C2 antibody with or without pre-incubation with 200 ng/mL human VEGF-A. Data represent the mean+/−SEM.

FIG. 31 A-C: ERK1/2 phosphorylation (T202/Y204—ERK1) (T185/Y187—ERK2) was measured in CHO cells stably expressing cyno TrkB after incubation with growing concentrations of Doppelmabs (A) TPP-14940, (B) TPP-14941 or (C) C2 antibody with or without pre-incubation with 200 ng/mL human VEGF-A. Data represent the mean+/−SEM.

FIG. 32 A-C: VEGF-A scavenging was assessed by measuring (A) VEGF receptor 2 phosphorylation (Y1175), (B) ERK1/2 phosphorylation (T202/Y204—ERK1) (T185/Y187—ERK2) or (C) Src phosphorylation (Y419). For this purpose, human retinal microvascular endothelial cells (HRMECs) were starved and then incubated with 50 ng/mL human VEGF with or without pre-incubation with growing concentrations of the indicated molecules. 50 ng/ml human VEGF without antibody treatment served as control. Data represent mean+/−SEM.

FIG. 33 A-C: Human retinal microvascular endothelial cells (HRMECs) were starved and then incubated with 10 ng/mL human VEGF with or without pre-incubation with growing concentrations of the indicated molecules: (A) TPP-11736, (B) TPP-14938 (C) TPP-14939. Molecule concentrations are given in mol/L. VEGF-A scavenging was assessed by image-based quantification of HRMEC cell numbers. Relative cell numbers are shown. Cell numbers at t=0 were set to one. Non-stimulated cells served as control (Basal). Data represent mean+/−SEM.

FIG. 34 A-C: VEGF-A scavenging was assessed by measuring (A) VEGF receptor 2 phosphorylation (Y1175), (B) ERK1/2 phosphorylation (T202/Y204—ERK1) (T185/Y187—ERK2) or (C) Src phosphorylation (Y419). For this purpose, human retinal microvascular endothelial cells (HRMECs) were starved and then incubated with 50 ng/mL human VEGF with or without pre-incubation with growing concentrations of the indicated molecules. 50 ng/ml human VEGF without antibody treatment served as control. Data represent mean+/−SEM.

FIG. 35 A-D: VEGF-A scavenging was assessed by image-based quantification of HRMEC cell numbers. For this purpose, human retinal microvascular endothelial cells (HRMECs) were starved and then incubated with 10 ng/mL human VEGF with or without pre-incubation with growing concentrations of (A) TPP-14936, (B) TPP-14937, (C) TPP-14940 or (D) TPP-14941. Molecule concentrations are given in mol/L. Images were recorded every four hours for a total period of 84 hours. Relative cell numbers are shown. Cell numbers at t=0 were set to one. Non-stimulated cells served as control (Basal). Data represent mean+/−SEM.

FIG. 36 A-C: VEGF-A scavenging was assessed by measuring (A) VEGF receptor 2 phosphorylation (Y1175), (B) ERK1/2 phosphorylation (T202/Y204—ERK1) (T185/Y187—ERK2) or (C) Src phosphorylation (Y419). For this purpose, human retinal microvascular endothelial cells (HRMECs) were starved and then incubated with 50 ng/mL human VEGF with or without pre-incubation with growing concentrations of the indicated molecules. 50 ng/ml human VEGF without antibody treatment served as control. Data represent mean+/−SEM.

FIG. 37 A-D: VEGF-A scavenging was assessed by image-based quantification of HRMEC cell numbers. For this purpose, human retinal microvascular endothelial cells (HRMECs) were starved and then incubated with 10 ng/mL human VEGF with or without pre-incubation with growing concentrations of (A) TPP-14938, (B) TPP-14939, (C) TPP-14940 or (D) TPP-14941. Molecule concentrations are given in mol/L. Images were recorded every four hours for a total period of 84 hours. Relative cell numbers are shown. Cell numbers at t=0 were set to one. Non-stimulated cells served as control (Basal). Data represent mean+/−SEM.

FIG. 44 A-D: TrkB phosphorylation (Y706/707) was measured in CHO cells stably expressing human TrkB after incubation with growing concentrations of Doppelmabs (A) TPP-22180 vs. TPP-22204; (B) TPP-22192 vs. TPP-22216; (C) TPP-22190 vs. TPP-22214; (D) TPP-22191 vs. TPP-22215. Data represent mean+/−SEM.

FIG. 45 A-B: TrkB phosphorylation (Y706/707) was measured in CHO cells stably expressing rat TrkB after incubation with growing concentrations of Doppelmabs (A) TPP-22180 vs. TPP-22204; (B) TPP-22192 vs. TPP-22216. Data represent mean+/−SEM.

FIG. 46 A-C: Trk phosphorylation (Y706/707) was measured in CHO cells stably expressing (A) human TrkA, (B) human TrkB or (C) human TrkC after incubation with growing concentrations the C2 antibody or the Doppelmabs TPP-22204 or TPP-22214. The natural ligands NGF for TrkA, BDNF for TrkB, and NT-3 for TrkC were used as controls. Data represent mean+/−SEM.

FIG. 47 A-B: TrkB phosphorylation (Y706/707) was measured in CHO cells stably expressing human TrkB receptor after incubation with (A) growing concentrations of the C2 antibody with or without constant concentrations of 0.3 nM, 1 nM or 3 nM BDNF or (B) growing concentrations of the Doppelmab TPP-22214 with or without constant concentrations of 0.3 nM, 1 nM or 3 nM BDNF. Data represent the mean+/−SEM.

FIG. 48 A-D: TrkB phosphorylation (Y706/707) was measured in CHO cells stably expressing human TrkB receptor after incubation with growing concentrations of Doppelmab TPP-22214 with or without pre-incubation with (A) 200 ng/mL human VEGF-A (hVEGF), (B) 50 ng/mL hVEGF, (C) 10 ng/mL hVEGF or (D) 2 ng/mL hVEGF. Data represent the mean+/−SEM.

FIG. 49 A-D: ERK1/2 phosphorylation (T202/Y204—ERK1) (T185/Y187—ERK2) was measured in CHO cells stably expressing human TrkB after incubation with growing concentrations of Doppelmab TPP-22214 with or without pre-incubation with (A) 200 ng/mL human VEGF-A (hVEGF), (B) 50 ng/mL hVEGF, (C) 10 ng/mL hVEGF or (D) 2 ng/mL hVEGF. Data represent the mean+/−SEM.

FIG. 53 A-B: VEGF-A scavenging was assessed by measuring VEGF receptor 2 phosphorylation (Y1175). For this purpose, human retinal microvascular endothelial cells (HRMECs) were starved and then incubated with 50 ng/mL human VEGF with or without pre-incubation with growing concentrations of the indicated molecules. (A) Comparison of Doppelmabs TPP-14941, TPP-22216, TPP-22192, TPP-22204, and TPP-22180. (B) Comparison of Doppelmabs TPP-14940, TPP-14941, TPP-22190, TPP-22214, TPP-22191 and TPP-22215. Non-stimulated cells (Basal) and 50 ng/ml human VEGF without molecule treatment served as control. Data represent mean+/−SEM.

FIG. 54 A-B: VEGF-A scavenging was assessed by measuring (A) VEGF receptor 2 (VEGFR2) phosphorylation (Y1175) or (B) ERK1/2 phosphorylation (T202/Y204—ERK1) (T185/Y187—ERK2). For this purpose, human retinal microvascular endothelial cells (HRMECs) were starved and then incubated with 50 ng/mL human VEGF with or without pre-incubation with growing concentrations of TPP-22214 or EYLEA® (aflibercept). 50 ng/ml human VEGF without molecule treatment served as control. Data represent mean+/−SEM.

FIG. 55 A-E: Human retinal microvascular endothelial cells (HRMECs) were starved and then incubated with 10 ng/mL human VEGF with or without pre-incubation with growing concentrations of the indicated molecules: (A) TPPP-22204, (B) TPP-22214c (C) TPP-22216 or (D) EYLEA® (aflibercept). Molecule concentrations are given in mol/L. VEGF-A scavenging was assessed by image-based quantification of HRMEC cell numbers. Images were recorded every four hours for a total period of 84 hours. Relative cell numbers are shown. Cell numbers at t=0 were set to one. Non-stimulated cells served as control (Basal). Data represent mean+/−SEM. (E) shows a plot of the difference of the area under the growth curves and the basal curves vs. the concentration of EYLEA® (aflibercept) or TPP-22214.

FIG. 56 A-B: VEGF-A scavenging was assessed by measuring (A) VEGF receptor 2 phosphorylation (Y1214) or (B) p38-MAPK phosphorylation (T180/Y182). For this purpose, human retinal microvascular endothelial cells (HRMECs) were starved and then incubated with 50 ng/mL human VEGF with or without pre-incubation with growing concentrations of TPP-22214 or EYLEA® (aflibercept). 50 ng/ml human VEGF without molecule treatment served as control. Data represent mean+/−SEM.

FIG. 57 A-B: Spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of TPP-22204, TPP-22214, TPP-22215, TPP-22216 or 5 nM EYLEA® (aflibercept). (A) Endothelial sprouting was assessed by confocal microscopy and displayed spheroid perimeter obtained from maximum projections of Z-stacks. Non-stimulated cells served as control (Basal). Data represent mean+/−SEM. n.s. p>0.05 non-significant, ****p<0.0001. (B) shows representative maximum projection images from spheroids after 24 hours of sprouting under basal conditions or after stimulation with 50 ng/mL human VEGF without or with pre-incubation with 2.5 nM TPP-22214 or 5 nM EYLEA® (aflibercept). Bar=100 μm.

FIG. 58 A-B: VEGF-A scavenging was assessed by measuring (A) VEGF receptor 2 phosphorylation (Y951) or (B) Src phosphorylation (Y419). For this purpose, human retinal microvascular endothelial cells (HRMECs) were starved and then incubated with 50 ng/mL human VEGF with or without pre-incubation with growing concentrations of TPP-22214 or EYLEA® (aflibercept). 50 ng/ml human VEGF without antibody treatment served as control. Data represent mean+/−SEM.

FIG. 59 A-B: TPP-22214 prevented human VEGF-A-induced hyperpermeability in the rat retina. (A) Time protocol showing the experimental procedure. Fifteen minutes after intravitreal (ivt) administration of the anti-VEGF compound (13 or 26 pmol per eye of EYLEA® (aflibercept) or TPP-14940) or the control (26 pmol TPP-11737), 13 pmol human VEGF-A per eye was administered by ivt injection. PBS injection served as control. Twenty-four hours later 1 mL/kg of an Evans Blue (EB) solution (45 mg/mL in 0.9% saline) were administered by intravenous (iv) injection for 30 minutes before the eyes were isolated and fixed. Plasma samples were collected at the same point in time to confirm equal systemic EB exposure. (B) Quantification of VEGF-A-induced hyperpermeability in the retinas of Brown Norway rats was done by measuring EB extravasation in retinal flatmounts by confocal microscopy. Eyes were cut along the Ora serrata, lens and vitreous were removed and the eye cup was fixed in paraformaldehyde (4%) for 1 h at 4° C. and then transferred to PBS overnight at 4° C. The retinae were separated from the outer segments (sclera and choroidea) and transferred to a glass slide and cut four times to achieve a flat cloverleaf-like structure. The tissue was covered with mounting medium (Vectashield H-1200 containing the DNA stain DAPI) and a coverslip was put on top to obtain a retinal flatmount. The samples were excited at a wavelength of 639 nm and emission of Evans Blue at 669 nm was recorded with a LSM 700 confocal laser scanning-microscope (Carl Zeiss, Jena; gain 800, laser strength 2%, 5 stacks of 60 μm) and images of the retinal flatmounts with maximum intensity projection were obtained. Analysis of fluorescence intensity sum was done after opening the images in the program ImageJ with a threshold of 30. ***p<0.001; *p<0.05; n.s. p>0.05. One-way Anova with Tukey multi comparison test, n=9-17. Incubation with 67:1 molar ratio of EYLEA® (aflibercept):VEGF is shown for comparison.

FIG. 60 A-B: (A) Functional characterization of the TkrB extracellular domain (TrkB-ECD). CHO cells with stable expression of human TrkB were incubated with growing concentrations of the natural ligand BDNF or 10 nM BDNF with growing concentrations of TrkB-ECD. TrkB activation was assessed by measuring TrkB phosphorylation (Y706/707). (B) Impact of TrkB-ECD binding of TPP-22214 on inhibition of VEGF-induced VEGFR2 phosphorylation. Human retinal microvascular endothelial cells (HRMECs) were starved and then incubated with 50 ng/mL human VEGF, 50 ng/mL human VEGF with growing concentrations of TPP-22214 or 50 ng/mL human VEGF with growing concentrations of TPP-22214 and 100 nM TrkB-ECD. HRMEC incubation with growing concentrations of TrkB-ECD with or without 50 ng/mL VEGF and unstimulated cells (Basal) served as control. VEGF-A scavenging was assessed by measuring VEGF receptor 2 phosphorylation (Y1175). Data represent mean+/−SEM.

FIG. 61 A-B: (A) TrkB phosphorylation (Y706/707) or (B) ERK1/2 phosphorylation (T202/Y204—ERK1) (T185/Y187—ERK2) was measured in CHO cells stably expressing human TrkB after incubation with growing concentrations of the indicated molecules. Data represent mean+/−SEM.

FIG. 62 A-C: TrkB phosphorylation (Y706/707) was measured in CHO cells stably expressing human TrkB after incubation with growing concentrations of Doppelmabs (A) TPP-23457, (B) TPP-23459 or (C) TPP-6830 antibody with or without pre-incubation with 200 ng/mL human VEGF-A. Data represent the mean+/−SEM.

FIG. 63 A-C: ERK1/2 phosphorylation (T202/Y204—ERK1) (T185/Y187—ERK2) was measured in CHO cells stably expressing human TrkB after incubation with growing concentrations of Doppelmabs (A) TPP-23457, (B) TPP-23459 or (C) TPP-6830 antibody with or without pre-incubation with 200 ng/mL human VEGF-A. Data represent the mean+/−SEM.

FIG. 64 A-B: TrkB phosphorylation (Y706/707) was measured in CHO cells stably expressing human TrkB receptor after incubation with (A) growing concentrations of the C2 antibody with or without constant concentrations of 0.3 nM, 1 nM or 3 nM BDNF or (B) growing concentrations of the Doppelmab TPP-23457 with or without constant concentrations of 0.3 nM, 1 nM or 3 nM BDNF. Data represent the mean+/−SEM.

FIG. 65 A-B: ERK1/2 phosphorylation (T202/Y204—ERK1) (T185/Y187—ERK2) was measured in CHO cells stably expressing human TrkB after incubation with (A) growing concentrations of the C2 antibody with or without constant concentrations of 0.3 nM, 1 nM or 3 nM BDNF or (B) growing concentrations of the Doppelmab TPP-23457 with or without constant concentrations of 0.3 nM, 1 nM or 3 nM BDNF. Data represent the mean+/−SEM.

FIG. 66 A-B: VEGF-A scavenging was assessed by measuring (A) VEGF receptor 2 (VEGFR2) phosphorylation (Y1175) or (B) ERK1/2 phosphorylation (T202/Y204—ERK1) (T185/Y187—ERK2). For this purpose, human retinal microvascular endothelial cells (HRMECs) were starved and then incubated with 50 ng/mL human VEGF with or without pre-incubation with growing concentrations of TPP-22215, TPP-23457, TPP-23459 or EYLEA® (aflibercept). 50 ng/ml human VEGF without molecule treatment served as control. Data represent mean+/−SEM.

DETAILED DESCRIPTION OF THE INVENTION

Figure 1:
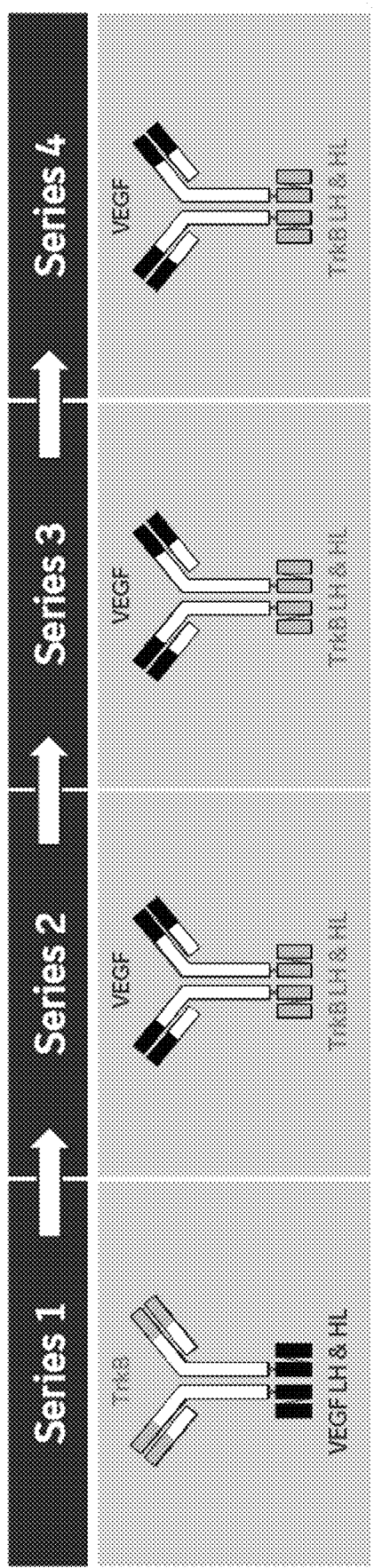
FIG. 1: Illustration of the design of VEGF-TrkB single binding molecules from series 1 to series 4.
Figure 6:
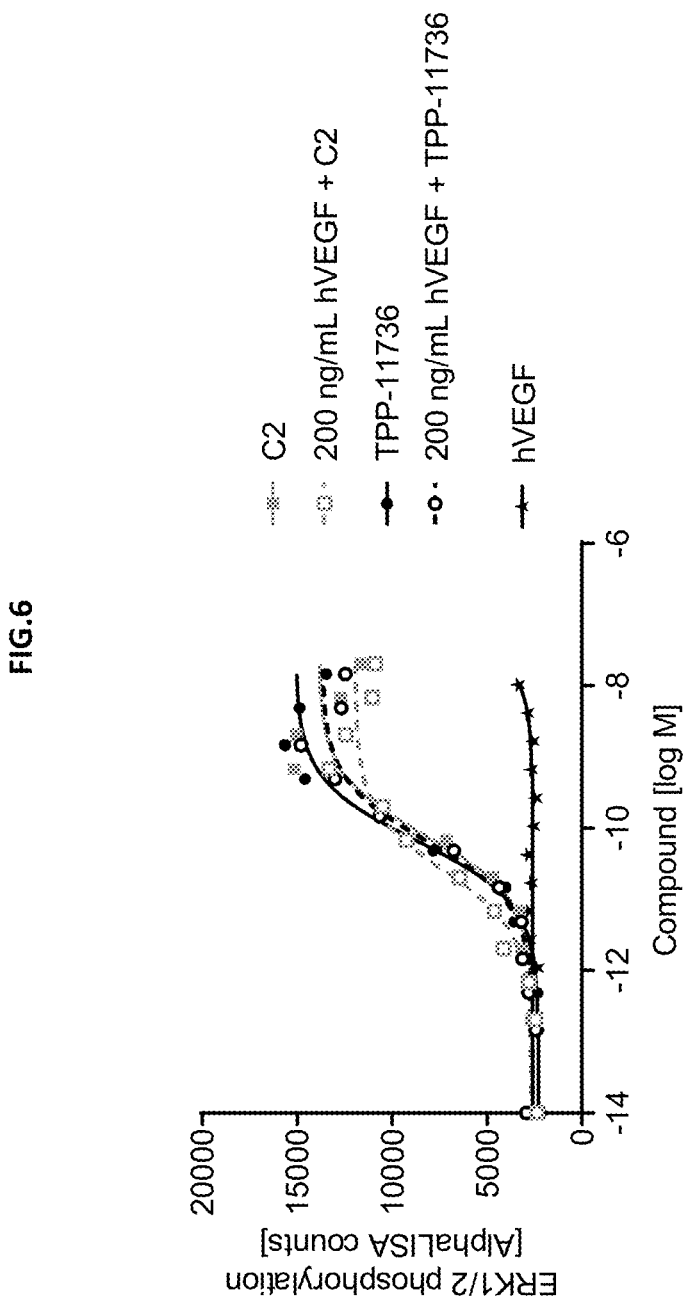
FIG. 6: ERK1/2 phosphorylation (T202/Y204—ERK1) (T185/Y187—ERK2) was measured in CHO cells stably expressing human TrkB after incubation with growing concentrations of the indicated molecules, with or without pre-incubation of 200 ng/mL human VEGF-A. Incubation only with VEGF-A served as control. Data represent the mean. For clarity error bars are omitted.

The present invention is based on the concept of combining an antigen binding site that binds specifically to Vascular Endothelial Growth Factor (VEGF) with an antigen binding site that binds specifically to Tropomyosin receptor kinase B (TrkB) within a single binding molecule.

It is important to point out that until the present invention it had not been disclosed or even remotely contemplated to prepare binding molecules targeting these two antigens. Accordingly, the inventors prepared binding molecules including at least one antigen binding site that binds specifically to VEGF and at least one antigen binding site that binds specifically to TrkB.

The initial goal of the inventors was to design a single binding molecule which had comparable efficacy and/or potency when compared to their respective individual binders, i.e. the individual VEGF or TrkB binder which only bind to their respective target. This was already considered challenging in itself, as it was not fully understood but expected that formatting of the individual binders into a single binding molecule would negatively impact the original efficacy and/or potency of the individual binders within the single binding molecule.

It was surprisingly found that combining TrkB activation with VEGF scavenging in a single binding molecule resulted in an unexpected increase of both efficacy as wells as potency of TrkB activation. The single binding molecules according to the invention show full TrkB agonist activity—opposed to partial agonist activity of the individual TrkB binder. Moreover, potency of TrkB activation is further enhanced after binding of VEGF to the single binding molecule.

Without wishing to be bound by theory it appears that VEGF induced clustering with the single binding molecules of the invention may be responsible for the observed increase in potency of TrkB activation. In addition, independently of the proposed VEGF induced clustering mechanism, apparently the design of the TrkB binding sites in the binding molecules of the invention support an optimal sterical formation of TrkB binding which resulted in the observed full TrkB agonist activity. Advantageously, by combining VEGF-scavenging (resulting in inhibition of vascular dysfunction and leakage) with the activation of the neuroprotective TrkB-receptor (resulting in reduction of neuronal death) the patients now benefit from a single injection. This is important as retinal specialists are not in favor to inject the same eye with more than one treatment on the same day. Therefore, two separate treatments addressing wAMD and GA would require two separate treatment visits per eye. In summary, the binding molecules according to the invention are useful for treatment and/or prevention of loss in visual function and thereby improvement in quality of life.

In one aspect, the present invention provides a binding molecule, in particular a molecule having at least one antigen binding site that binds specifically to vascular endothelial growth factor VEGF, preferably VEGF-A and at least one antigen binding site that binds specifically to Tropomyosin receptor kinase B (TrkB) having one or more of the properties described herein below.

In another aspect, a binding molecule of the present invention binds with high affinity to human TrkB. In an embodiment relating to this aspect, a binding molecule of the present invention binds to human TrkB at a $K_D<500$ nM. In another embodiment, a binding molecule of the present invention binds to human TrkB at a $K_D<450$ nM. In another embodiment, a binding molecule of the present invention binds to human TrkB at a $K_D<400$ nM. In another embodiment, a binding molecule of the present invention binds to human TrkB at a $K_D<300$ nM. In another embodiment, a binding molecule of the present invention binds to human TrkB at a $K_D<250$ nM. In an embodiment relating to this aspect, a binding molecule of the present invention binds to human TrkB at a $K_D<200$ nM. In another embodiment, a binding molecule of the present invention binds to human TrkB at a $K_D<150$ nM. In another embodiment, a binding molecule of the present invention binds to human TrkB at a $K_D<100$ nM. In another embodiment, a binding molecule of the present invention binds to human TrkB at a $K_D<50$ nM.

In another aspect, a binding molecule of the present invention—under conditions comprising pre-incubation with 200 ng/mL human VEGF-A—activates TrkB with high potency. In an embodiment relating to this aspect, a binding molecule of the present invention activates human TrkB with an $EC_{50}<100$ nM. In a further embodiment, a binding molecule of the present invention activates human TrkB with an $EC_{50}<90$ nm. In a further embodiment, a binding molecule of the present invention activates human TrkB with an $EC_{50}<80$ nm. In a further embodiment, a binding molecule of the present invention activates human TrkB with an $EC_{50}<70$ nm. In a further embodiment, a binding molecule of the present invention activates human TrkB with an $EC_{50}<60$ nm. In a further embodiment, a binding molecule of the present invention activates human TrkB with an $EC_{50}<50$ nm. In a further embodiment, a binding molecule of the present invention activates human TrkB with an $EC_{50}<40$ nm. In a further embodiment, a binding molecule of the present invention activates human TrkB with an $EC_{50}<30$ nm. In a further embodiment, a binding molecule of the present invention activates human TrkB with an $EC_{50}<20$ nm. In a further embodiment, a binding molecule of the present invention activates human TrkB with an $EC_{50}<10$ nm.

In another aspect, a binding molecule of the present invention binds with high affinity to human VEGF, preferably VEGF-A. In an embodiment relating to this aspect, a binding molecule of the present invention binds to human VEGF-A at a $K_D<1$ nM. In another embodiment, a binding molecule of the present invention binds to human VEGF-A at a $K_D<900$ pM. In another embodiment, a binding molecule of the present invention binds to human VEGF-A at a $K_D<800$ pM. In another embodiment, a binding molecule of the present invention binds to human VEGF-A at a $K_D<700$ pM. In another embodiment, a binding molecule of the present invention binds to human VEGF-A at a $K_D<600$ pM. In another embodiment, a binding molecule of the present invention binds to human VEGF-A at a $K_D<500$ pM. In another embodiment, a binding molecule of the present invention binds to human VEGF-A at a $K_D<400$ pM.

In another aspect, a binding molecule of the present invention inhibits VEGF-A phosphorylation (Tyr1175) with high potency. In an embodiment relating to this aspect, a binding molecule of the present invention inhibits human VEGF-A phosphorylation (Tyr1175) with an $IC_{50}<1$ nM. In an embodiment relating to this aspect, a binding molecule of the present invention inhibits human VEGF-A phosphorylation (Tyr1175) with an $IC_{50}<900$ pM. In an embodiment relating to this aspect, a binding molecule of the present invention inhibits human VEGF-A phosphorylation (Tyr1175) with an $IC_{50}<800$ pM. In an embodiment relating to this aspect, a binding molecule of the present invention inhibits human VEGF-A phosphorylation (Tyr1175) with an $IC_{50}<700$ pM. In an embodiment relating to this aspect, a binding molecule of the present invention inhibits human VEGF-A phosphorylation (Tyr1175) with an $IC_{50}<600$ pM. In an embodiment relating to this aspect, a binding molecule of the present invention inhibits human VEGF-A phosphorylation (Tyr1175) with an $IC_{50}<500$ pM. In an embodiment relating to this aspect, a binding molecule of the present invention inhibits human VEGF-A phosphorylation (Tyr1175) with an $IC_{50}<400$ pM. In an embodiment relating to this aspect, a binding molecule of the present invention inhibits human VEGF-A phosphorylation (Tyr1175) with an $IC_{50}<300$ pM.

In another aspect, a binding molecule of the present invention is more potent in inducing activation of TrkB downstream signaling pathways than the natural TrkB ligand, BDNF. In a further aspect, a binding molecule of the present invention regulates gene expression through TrkB-mediated signaling pathways in a comparable pattern to that of BDNF.

In yet another aspect, a binding molecule of the present invention does not reduce BDNF induced ERK phosphorylation. In a further aspect, a binding molecule of the present invention is specific for TrkB phosphorylation and/or activation and does not unspecifically phosphorylate/activate TrkA or TrkC.

In one aspect, the binding molecules according to the invention are useful to prevent neurodegeneration and loss of retinal function in a disease-related animal model. In yet a further aspect a binding molecule of the present invention protects neurons, glial cells and/or the neurovascular unit in the retina of patients with e.g. macular degeneration, age-related macular degeneration, geographic atrophy or diabetic retinopathy by stimulating TrkB-dependent survival signaling pathways and thereby providing neuroprotection.

In another aspect a binding molecule of the present invention regenerates axons/dendrites and/or synapses in the retina after disease onset in e.g. macular degeneration, age-related macular degeneration, geographic atrophy or diabetic retinopathy and thereby resulting in neuroregeneration. In one aspect, a binding molecule of the present invention can be formulated to high concentrations for intravitreal injections into the eye.

In another aspect, the binding molecules according to the invention show superior VEGF-A scavenging compared to the current anti-VEGF standard of care compound aflibercept (EYLEA) in terms of inhibition of VEGF-induced signaling, endothelial cell proliferation/sprouting and/or inhibition of VEGF-induced hyperpermeability in the rat retina.

In another aspect, the binding molecules according to the invention show a substantially longer vitreal half-life in rabbit PK studies compared to e.g. EYLEA® (aflibercept) or other IgG antibodies. Accordingly the binding molecules according to the invention are suitable for a quarterly injection or even less frequent injections.

In another aspect, the binding molecules according to the invention are useful to target the high unmet need of patients with wAMD and at risk of developing geographic atrophy. In a related embodiment the binding molecules according to the invention are uniquely useful for treating patients with wAMD and preventing the development of geographic atrophy. In a further related embodiment, the development of geographic atrophy is delayed or the severity of the disease is reduced, i.e. a reduction of the onset and/or the rate of progression of geographic atrophy. In this respect treatment of patients with the binding molecules according to the invention may already be initiated before the definite diagnosis of geographic atrophy, i.e. for patients being at risk of developing geographic atrophy.

In another aspect, the binding molecules according to the invention are useful to target the high unmet need of patients with retinal vein occlusion (CRVO).

In another aspect, the binding molecules according to the invention improve the ERG-deficit implicit time when compared to the current standard of care (EYLEA® (aflibercept)).

In one aspect, binding of the binding molecules according to the invention to TrkB does not induce receptor internalization. In a related aspect, binding of the binding molecules according to the invention to TrkB will result in less receptor internalization when compared to the natural ligand BDNF.

In one aspect, VEGF-A binding to the binding molecules according to the invention increases the potency of TrkB activation.

Said increase in potency may be measured e.g. in vitro by determining the $EC_{50}$ for TrkB or Erk1/2 phosphorylation in an appropriate cell model after treatment with the single binding molecules, e.g such as in CHO cells overexpressing (human) TrkB (cf. examples). The single binding molecules will be tested with or without pre-incubating the cells with appropriate concentrations of human VEGF-A (hVEGF), such as 200 ng/mL, 50 ng/mL, 10 ng/mL or 2 ng/mL. After pre-incubation of the cells with human VEGF-A the single binding molecules of the invention will show an increase in potency, as measured by $EC_{50}$ for TrkB or Erk1/2 phosphorylation of at least approximately 2-fold, 3-fold, 4-fold, 5-fold, 6-fold, 7-fold, 8-fold, 9-fold or at least approximately 10-fold increase in potency when compared to cells not pre-incubated with VEGF-A.

In another aspect, the binding molecules according to the invention show full TrkB agonist activity. Hence, the binding molecules according to the invention are as efficacious in activating TrkB as the natural ligand BDNF.

In another aspect, the binding molecules according to the invention can simultaneously activate the TrkB receptor and scavenge VEGF, preferably VEGF-A.

Definitions

Terms not specifically defined herein should be given the meanings that would be given to them by one of skill in the art in light of the disclosure and the context. As used in the specification, however, unless specified to the contrary, the following terms have the meaning indicated and the following conventions are adhered to.

As used herein the term "antigen binding site" comprises a heavy chain variable domain (VH) and a light chain variable domain (VL) derived from an antibody. In such case, each variable domain comprises 3 CDRs. In one aspect, an antigen binding site according to the present invention or certain portions of the protein is generally derived from an antibody. The generalized structure of antibodies or immunoglobulin molecules is well known to those of skill in the art.

"Antibodies" or "immunoglobulin molecules" (also known as immunoglobulins, abbreviated Ig) are gamma globulin proteins that can be found in blood or other bodily fluids of vertebrates, and are used by the immune system to identify and neutralize foreign objects, such as bacteria and viruses. They are typically made of basic structural units—each with two large heavy chains and two small light chains—to form, for example, monomers with one unit, dimers with two units or pentamers with five units. Antibodies can bind, by non-covalent interaction, to other molecules or structures known as antigens. This binding is specific in the sense that an antibody will only bind to a specific structure with high affinity. The unique part of the antigen recognized by an antibody is called an epitope, or antigenic determinant. The part of the antibody binding to the epitope is sometimes called paratope and resides in the so-called variable domain, or variable region (Fv) of the antibody. The variable domain comprises three so-called complementary-determining region (CDR's) spaced apart by framework regions (FR's).

Within the context of this invention, reference to CDR's is based on different definitions, such as e.g. CCG, also referred to as IMGT (Lefranc M P, Pommié C, Ruiz M, Giudicelli V, Foulquier E, Truong L, Thouvenin-Contet V, Lefranc G. "IMGT unique numbering for immunoglobulin and T cell receptor variable domains and Ig superfamily V-like domains." Dev Comp Immunol. 2003 January; 27(1): 55-77; Giudicelli V, Brochet X, Lefranc M P. "IMGT/V-QUEST: IMGT standardized analysis of the immunoglobulin (IG) and T cell receptor (TR) nucleotide sequences". Cold Spring Harb Protoc. 2011; 2011(6):695-715. An alternative definition of CDRs is based on Chothia (Chothia and Lesk, J. Mol. Biol. 1987, 196: 901-917), together with Kabat (E. A. Kabat, T. T. Wu, H. Bilofsky, M. Reid-Miller and H. Perry, Sequence of Proteins of Immunological Interest, National Institutes of Health, Bethesda (1983)).

The expressions "variable domains" or "variable region" or Fv as used herein denotes each of the pair of light and heavy chains which is involved directly in binding the antibody to the antigen. The variable domain of a light chain is abbreviated as "VL" and the variable domain of a heavy chain is abbreviated as "VH". The variable light and heavy chain domains have the same general structure and each domain comprises four framework (FR) regions whose sequences are widely conserved, connected by three HVRs (or CDRs). The framework regions adopt a beta-sheet conformation and the CDRs may form loops connecting the beta-sheet structure. The CDRs in each chain are held in their three-dimensional structure by the framework regions and form together with the CDRs from the other chain the antigen binding site. The antibody's heavy and light chain CDR3 regions play a particularly important role in the binding specificity/affinity of the antibodies according to the invention and therefore provide a further object of the invention. The term "constant domains" or "constant region" as used within the current application denotes the sum of the domains of an antibody other than the variable region. Such constant domains and regions are well known in the state of the art and e.g. described by Kabat et al. ("Sequence of proteins of immunological interest", US Public Health Services, NIH Bethesda, MD, Publication No. 91).

The "Fc part" of an antibody is not involved directly in binding of an antibody to an antigen, but exhibit various effector functions. An "Fc part of an antibody" is a term well known to the skilled artisan and defined on the basis of papain cleavage of antibodies. Depending on the amino acid sequence of the constant region of their heavy chains, antibodies or immunoglobulins are divided in the classes: IgA, IgD, IgE, IgG and IgM. According to the heavy chain constant regions the different classes of immunoglobulins are called α, δ, ε, γ, and μ respectively. Several of these may be further divided into subclasses (isotypes), e.g. IgG1, IgG2, IgG3, and IgG4, IgA1, and IgA2. The Fc part of an antibody is directly involved in ADCC (antibody dependent cell-mediated cytotoxicity) and CDC (complement-dependent cytotoxicity) based on complement activation, C1q binding and Fc receptor binding. Complement activation (CDC) is initiated by binding of complement factor C1q to the Fc part of most IgG antibody subclasses. While the influence of an antibody on the complement system is dependent on certain conditions, binding to C1q is caused by defined binding sites in the Fc part. Such binding sites are known in the state of the art and described e.g. by Boakle et al., Nature 282 (1975) 742-743, Lukas et al., J. Immunol. 127 (1981) 2555-2560, Brunhouse and Cebra, Mol. Immunol. 16 (1979) 907-917, Burton et al., Nature 288 (1980) 338-344, Thommesen et al., Mol. Immunol. 37 (2000) 995-1004, Idusogie et al., J. Immunol. 164 (2000) 4178-4184, Hezareh et al., J. Virology 75 (2001) 12161-12168, Morgan et al., Immunology 86 (1995) 319-324, EP 0307434. Such binding sites are e.g. L234, L235, D270, N297, E318, K320, K322, P331 and P329 (numbering according to EU index of Kabat, see below). Most crucial among these residues in mediating C1q and Fcgamma receptor binding in IgG1 are L234 and L235 (Hezareh et al., J. Virology 75 (2001) 12161-12168). Antibodies of subclass IgGI and IgG3 usually show complement activation and C1q and C3 binding, whereas IgG2 and IgG4 do not activate the complement system and do not bind C1q and C3.

The art has further developed antibodies and made them versatile tools in medicine and technology. Thus, in the context of the present invention the terms "antibody molecule" or "antibody" or "Ig molecule" (used synonymously herein) do not only include antibodies as they may be found in nature, comprising e.g. two light chains and two heavy chains, or just two heavy chains in camelid species, but furthermore encompasses all molecules comprising at least one paratope with binding specificity to an antigen and structural similarity to a variable domain of an immunoglobulin.

Thus, an antibody or immunoglobulin or Ig molecule may comprise a monoclonal antibody, a human antibody, a humanized antibody, a chimeric antibody, a fragment of an antibody, in particular a Fv, Fab, Fab', or F(ab')2 fragment, a single chain antibody, in particular a single chain variable fragment (scFv), a Small Modular Immunopharmaceutical (SMIP), a domain antibody, a nanobody, a diabody. The antibody may have an effector function, such as ADCC or CDC, that is usually mediated by the Fc part (antibody constant region) of the antibody, or it may have no effector function, e.g. by lacking a Fc part or having a blocked, masked Fc part, in essence a Fc part that is not or insufficiently recognized by immune cells or immune system components, like the complement system. Monoclonal antibodies (mAb) are monospecific antibodies that are identical in amino acid sequence. They may be produced by hybridoma technology from a hybrid cell line (called hybridoma) representing a clone of a fusion of a specific antibody-producing B cell with a myeloma (B cell cancer) cell (Kohler G, Milstein C. Continuous cultures of fused cells secreting antibody of predefined specificity. Nature 1975; 256:495-7.). Alternatively, monoclonal antibodies may be produced by recombinant expression in host cells (Norderhaug L, Olafsen T, Michaelsen T E, Sandlie I. (May 1997). "Versatile vectors for transient and stable expression of recombinant antibody molecules in mammalian cells." J Immunol Methods 204 (1): 77-87; see also below). A "recombinant antibody" or "recombinant binding molecule" is an antibody or binding molecule which has been produced by a recombinantly engineered host cell. It is optionally isolated or purified.

For application in man, it is often desirable to reduce immunogenicity of antibodies originally derived from other species, like mouse. This can be done by construction of chimeric antibodies, or by a process called "humanization". In this context, a "chimeric antibody" is understood to be antibody comprising a sequence part (e.g. a variable domain) derived from one species (e.g. mouse) fused to a sequence part (e.g. the constant domains) derived from a different species (e.g. human). A "humanized antibody" is an antibody comprising a variable domain originally derived from a non-human species, wherein certain amino acids have been mutated to make the overall sequence of that variable domain more closely resemble to a sequence of a human variable domain. Methods of chimerisation and humanization of antibodies are well-known in the art (Billetta R, Lobuglio A F. "Chimeric antibodies". Int Rev Immunol. 1993; 10(2-3):165-76; Riechmann L, Clark M, Waldmann H, Winter G (1988). "Reshaping human antibodies for therapy". Nature: 332:323).

A "humanized" antibody refers to an antibody comprising amino acid residues from non-human hypervariable regions (HVRs) and amino acid residues from human FRs. In certain embodiments, a humanized antibody will comprise substantially all of at least one, and typically two, variable domains, in which all or substantially all of the HVRs (e.g. complementary determining regions (CDRs)) correspond to those of a non-human antibody, and all or substantially the entire framework regions (FRs) correspond to those of a human antibody. A humanized antibody optionally may comprise at least a portion of an antibody constant region derived from a human antibody. A "humanized form" of an antibody, e.g. a non-human antibody, refers to an antibody that has undergone humanization.

Furthermore, technologies have been developed for creating antibodies based on sequences derived from the human genome, for example by phage display or use of transgenic animals (WO 90/05144; D. Marks, H. R. Hoogenboom, T. P. Bonnert, J. McCafferty, A. D. Griffiths and G. Winter (1991) "By-passing immunisation. Human antibodies from V-gene libraries displayed on phage." J. Mol. Biol., 222, 581-597; Knappik et al., J. Mol. Biol. 296: 57-86, 2000; S. Carmen and L. Jermutus, "Concepts in antibody phage display". Briefings in Functional Genomics and Proteomics 2002 1(2):189-203; Lonberg N, Huszar D. "Human antibodies from transgenic mice". Int Rev Immunol. 1995; 13(1):65-93.; Brüggemann M, Taussig M J. "Production of human antibody repertoires in transgenic mice". Curr Opin Biotechnol. 1997 August; 8(4):455-8.). Such antibodies are "human antibodies" in the context of the present invention.

Antibody can also include fragments of immunoglobulins which retain antigen binding properties, like Fab, Fab', or F(ab')2 fragments. Such fragments may be obtained by fragmentation of immunoglobulins e.g. by proteolytic digestion, or by recombinant expression of such fragments. For example, immunoglobulin digestion can be accomplished by means of routine techniques, e.g. using papain or pepsin (WO 94/29348). Papain digestion of antibodies typically produces two identical antigen binding fragments, so-called Fab fragments, each with a single antigen binding site, and a residual Fc fragment. Pepsin treatment yields an F(ab')2. In Fab molecules, the variable domains are each fused to an immunoglobulin constant domain, preferably of human origin. Thus, the heavy chain variable domain may be fused to a CH1 domain (a so-called Fd fragment), and the light chain variable domain may be fused to a CL domain. Fab molecules may be produced by recombinant expression of respective nucleic acids in host cells, see below.

A number of technologies have been developed for placing variable domains of immunoglobulins, or molecules derived from such variable domains, in a different molecular context. Those should be also considered as "antibodies" in accordance with the present invention. In general, these antibody molecules are smaller in size compared to immunoglobulins, and may comprise a single amino acid chain or several amino acid chains. For example, a single-chain variable fragment (scFv) is a fusion of the variable regions of the heavy and light chains of immunoglobulins, linked together with a short linker, usually serine (S) or glycine (G) (WO 88/01649; WO 91/17271; Huston et al; International Reviews of Immunology, Volume 10, 1993, 195-217). "Single domain antibodies" or "nanobodies" harbour an antigen-binding site in a single Ig-like domain (WO 94/04678; WO 03/050531, Ward et al., Nature. 1989 Oct. 12; 341(6242):544-6; Revets et al., Expert Opin Biol Ther. 5(1):111-24, 2005). One or more single domain antibodies with binding specificity for the same or a different antigen may be linked together. Diabodies are bivalent antibody molecules consisting of two amino acid chains comprising two variable domains (WO 94/13804, Holliger et al., Proc Natl Acad Sci USA. 1993 Jul. 15; 90(14):6444-8). Other examples of antibody-like molecules are immunoglobulin super family antibodies (IgSF; Srinivasan and Roeske, Current Protein Pept. Sci. 2005, 6(2): 185-96). A different concept leads to the so-called Small Modular Immunopharmaceutical (SMIP) which comprises a Fv domain linked to single-chain hinge and effector domains devoid of the constant domain CH1 (WO 02/056910).

As used herein, the term "binding" or "specifically binding" refers to the binding of an antibody or antigen binding site (e.g., in the binding molecule described herein) to an epitope of the antigen in an in-vitro assay. Affinity is the interaction between a single antigen-binding site on an antibody molecule and a single epitope. It is expressed by the equilibrium association constant Ka=kon/koff, or the equilibrium dissociation constant Kd=koff/kon.

The binding affinity of an antibody molecule may be enhanced by a process known as affinity maturation (Marks et al., 1992, Biotechnology 10:779-783; Barbas, et al., 1994, Proc. Nat. Acad. Sci, USA 91:3809-3813; Shier et al., 1995, Gene 169:147-155). Affinity matured antibodies are therefore also embraced in the present invention.

An epitope is a region of an antigen that is bound by an antibody or antigen binding moiety. The term "epitope" includes any polypeptide determinant capable of specific binding to an antibody or antigen binding moiety. In certain embodiments, epitope determinants include chemically active surface groupings of molecules such as amino acids, glycan side chains, phosphoryl, or sulfonyl, and, in certain embodiments, may have specific three-dimensional structural characteristics, and/or specific charge characteristics. Conformational and non-conformational epitopes are distinguished in that the binding to the former but not the latter is lost in the presence of denaturing solvents. As used herein, the terms "binding" and "specific binding" refer to the binding of the antibody or antigen binding moiety to an epitope of the antigen in an in vitro assay, preferably in a plasmon resonance assay (BIAcore®, GE-Healthcare Uppsala, Sweden) with purified wild-type antigen.

A "single chain Fv fragment" (scFv) is a polypeptide comprising an antibody heavy chain variable domain (VH), a linker, and an antibody light chain variable domain (VL), wherein said antibody domains and said linker have one of the following orders in N-terminal to C-terminal direction: a) VH-linker-VL, b) VL-linker-VH; and wherein said linker is a polypeptide of 15 to 25 amino acids, preferably 20 amino acids, in length.

As used herein, the terms "identical" or "percent identity," in the context of two or more nucleic acids or polypeptide sequences, refer to two or more sequences or subsequences that are the same or have a specified percentage of nucleotides or amino acid residues that are the same, when compared and aligned for maximum correspondence. To determine the percent identity, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In some embodiments, the two sequences that are compared are the same length after gaps are introduced within the sequences, as appropriate (e.g., excluding additional sequence extending beyond the sequences being compared). For example, when variable region sequences are compared, the leader and/or constant domain sequences are not considered. For sequence comparisons between two sequences, a "corresponding" CDR refers to a CDR in the same location in both sequences (e.g., CDR-H1 of each sequence).

The determination of percent identity or percent similarity between two sequences can be accomplished using a mathematical algorithm. A preferred, non-limiting example of a mathematical algorithm utilized for the comparison of two sequences is the algorithm of Karlin and Altschul, 1990, Proc. Natl. Acad. Sci. USA 87:2264-2268, modified as in Karlin and Altschul, 1993, Proc. Natl. Acad. Sci. USA 90:5873-5877. Such an algorithm is incorporated into the NBLAST and XBLAST programs of Altschul et al., 1990, J. Mol. Biol. 215:403-410. BLAST nucleotide searches can be performed with the NBLAST program, score=100, wordlength=12, to obtain nucleotide sequences homologous to a nucleic acid encoding a protein of interest. BLAST protein searches can be performed with the XBLAST program, score=50, wordlength=3, to obtain amino acid sequences homologous to a protein of interest. To obtain gapped alignments for comparison purposes, Gapped BLAST can be utilized as described in Altschul et al., 1997, Nucleic Acids Res. 25:3389-3402. Alternatively, PSI-Blast can be used to perform an iterated search which detects distant relationships between molecules (Id.). When utilizing BLAST, Gapped BLAST, and PSI-Blast programs, the default parameters of the respective programs (e.g., XBLAST and NBLAST) can be used. Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti, 1994, Comput. Appl. Biosci. 10:3-5; and FASTA described in Pearson and Lipman, 1988, Proc. Natl. Acad. Sci. USA 85:2444-8. Within FASTA, ktup is a control option that sets the sensitivity and speed of the search. If ktup=2, similar regions in the two sequences being compared are found by looking at pairs of aligned residues; if ktup=1, single aligned amino acids are examined. ktup can be set to 2 or 1 for protein sequences, or from 1 to 6 for DNA sequences. The default if ktup is not specified is 2 for proteins and 6 for DNA. Alternatively, protein sequence alignment may be carried out using the CLUSTAL W algorithm, as described by Higgins et al., 1996, Methods Enzymol. 266:383-402.

The "therapeutically effective amount" of the molecule to be administered is the minimum amount necessary to prevent, ameliorate, or treat clinical symptoms of e.g. eye or retinal or neurodegenerative diseases, in particular the minimum amount which is effective to these disorders.

As used herein, the terms "monovalent", "bivalent", "tetravalent" refer to the number (one, two or four, respectively) of antigen binding elements in a binding molecule.

As used herein, the terms "monospecific", "bispecific" refer to the number (one, two) of different antigens or epitopes a binding molecule specifically binds.

By way of example, a typical monoclonal antibody (MAb) is bivalent and monospecific, with two antigen-binding arms that both recognize the same epitope. Bispecific antibodies have two antigen-binding sites, which are capable of recognizing and binding two different antigens or epitopes.

TrkB Binding

Tropomyosin receptor kinase B (TrkB), also known as tyrosine receptor kinase B, or BDNF/NT-3 growth factors receptor or neurotrophic tyrosine kinase, receptor, type 2, is a protein that in humans is encoded by the NTRK2 gene (Genbank ID: 4915). TrkB is a receptor for brain-derived neurotrophic factor (BDNF).

The neurotrophic tyrosine kinase receptor B (TrkB; gene symbol: NTRK2) is expressed by retinal neurons and glial cells. In the normal retina, TrkB signaling counteracts cell stress and promotes cell survival. In the diseased eye, such as in diabetic retinopathy or geographic atrophy, loss and functional impairments of retinal neurons and glial cells occur which cause visual impairments and vision loss. Activating TrkB signaling above the basal level (which is reduced in diabetic retinopathy), can counteract the loss and functional impairments of neurons and glial cells, thus improving visual function. Furthermore, TrkB activation has the potential to regenerate lost synaptic connections in the diseased eye, thereby promoting the regain of visual function. Upon ligand binding, TrkB undergoes homodimerization followed by autophosphorylation. Dependent on the phosphorylation sites (Y516, Y702, Y706, Y707 or Y817) different signal transduction pathways are activated, including the activity of PLCγ1 or different subforms of AKT and ERK which regulate distinct overlapping signalling cascades inducing axonal/neurite outgrowth, increasing synaptic plasticity, or increasing cell survival.

The TrkB-binding components of the binding molecules according to the invention, e.g. scFv or scFv$_2$ specifically bind to native or recombinant human TrkB. By binding to TrkB the binding molecules of the invention thereby activate TrkB signaling, hence the binding molecules of the invention act as TrkB agonists.

The binding molecules of the present invention may recognize specific "TrkB antigen epitope" and "TrkB epitope". In particular, the binding molecules of the invention bind to an epitope in the extracellular domain of human TrkB. Preferably, the TrkB-binding components of the binding molecule is a TrkB agonist and more preferably a full agonist.

The extracellular domain of human TrkB essentially comprises the following sequence (SEQ ID NO. 226):

CPTSCKCSASRIWCSDPSPGIVAFPRLEPNSVDPENITEIFIANQKRLEI

INEDDVEAYVGLRNLTIVDSGLKFVAHKAFLKNSNLQHINFTRNKLTSLS

RKHFRHLDLSELILVGNPFTCSCDIMWIKTLQEAKSSPDTQDLYCLNESS

KNIPLANLQIPNCGLPSANLAAPNLTVEEGKSITLSCSVAGDPVPNMYWD

VGNLVSKHMNETSHTQGSLRITNISSDDSGKQISCVAENLVGEDQDSVNL

TVHFAPTITFLESPTSDHHWCIPFTVKGNPKPALQWFYNGAILNESKYIC

TKIHVTNHTEYHGCLQLDNPTHMNNGDYTLIAKNEYGKDEKQISAHFMGW

PGIDDGANPNYPDVIYEDYGTAANDIGDTTNRSNEIPSTDVTDKTGREH

As used herein, the terms "TrkB antigen epitope" and "TrkB epitope" refer to a molecule (e.g., a peptide) or a fragment of a molecule capable of binding to an antigen binding site of the binding molecule or binding molecules fragments according to the invention that binds specifically to Tropomyosin receptor kinase B. These terms further include, for example, a TrkB antigenic determinant recognized by any of the binding molecules or binding molecules fragments of the present invention, which has a light and heavy chain CDR combination selected from:

Light chain CDRs comprising the amino acid sequences of SEQ ID NO:201 (CDR1), SEQ ID NO:202 (CDR2) and SEQ ID NO:203 (CDR3), and Heavy chain CDRs comprising the amino acid sequences of SEQ ID NO:204 (CDR1), SEQ ID NO:205 (CDR2) and SEQ ID NO:206 (CDR3); or Heavy chain CDRs comprising the amino acid sequences of SEQ ID NO:207 (CDR1), SEQ ID NO:208 (CDR2) and SEQ ID NO:209 (CDR3); or Heavy chain CDRs comprising the amino acid sequences of SEQ ID NO:210 (CDR1), SEQ ID NO:211 (CDR2) and SEQ ID NO:212 (CDR3).

TrkB antigen epitopes can be included in proteins, protein fragments, peptides or the like. The epitopes are most commonly proteins, short oligopeptides, oligopeptide mimics (i.e., organic compounds that mimic antibody binding properties of the TrkB antigen), or combinations thereof.

VEGF Binding

Vascular endothelial growth factor (VEGF) is one of the most important pro-angiogenic factors, also termed VEGF-A or vascular permeability factor (VPF). VEGF belongs to a gene family that includes placenta growth factor (PIGF), VEGF-B, VEGF-C, VEGF-D, VEGF-E and VEGF-F. Alternative splicing of mRNA of a single gene of human VEGF results in at least six isoforms (VEGF121, VEGF145, VEGF165, VEGF183, VEGF189, and VEGF206), VEGF165 being the most abundant isoform.

Two VEGF tyrosine kinase receptors (VEGFR) have been identified that interact with VEGF, i.e. VEGFR-1 (also known as Flt-1) and VEGFR-2 (also known as KDR or FIK-1). VEGFR-1 has the highest affinity for VEGF, while VEGFR-2 has a somewhat lower affinity for VEGF. Ferrara (Endocrine Rev. 2004, 25: 581-611) provide a detailed description of VEGF, the interaction with its receptors and its function in normal and pathological processes can be found in Hoeben et al. Pharmacol. Rev. 2004, 56: 549-580.

VEGF has been reported to be a pivotal regulator of both normal and abnormal angiogenesis (Ferrara and Davis-Smyth, Endocrine Rev. 1997, 18: 4-25; Ferrara J. MoL Med. 1999, 77: 527-543). Compared to other growth factors that contribute to the processes of vascular formation, VEGF is unique in its high specificity for endothelial cells within the vascular system.

VEGF is in particular involved in eye diseases. The concentration of VEGF in eye fluids is highly correlated with the presence of active proliferation of blood vessels in patients with diabetic and other ischemia-related retinopathies. Furthermore, studies have demonstrated the localization of VEGF in choroidal neovascular membranes in patients affected by age-related macular degeneration (AMD).

The VEGF-binding components of the binding molecule according to the invention, e.g. immunoglobulin (Ig) molecules, have specificity for VEGF in that they bind specifically to one or more epitopes within the VEGF molecule. By binding to VEGF the binding molecules of the invention act as VEGF antagonists. Preferably, the binding molecules of the invention bind specifically to VEGF-A.

Specific binding of a VEGF-binding component to its antigen VEGF can be determined in any suitable manner known per se, including, for example, the assays described herein, Scatchard analysis and/or competitive binding assays, such as radioimmunoassays (RIA), enzyme immunoassays (EIA and ELISA) and sandwich competition assays, and the different variants thereof known per se in the art. The same is true for an TrkB-binding component when binding to its antigen.

With regard to the antigen VEGF, a VEGF-binding component of the invention, e.g. an immunoglobulin (Ig) molecule, is not limited with regard to the species. Thus, the immunoglobulin (Ig) molecule preferably binds to human VEGF, if intended for therapeutic purposes in humans. However, immunoglobulin (Ig) molecules that bind to VEGF from another mammalian species are also within the scope of the invention. An immunoglobulin (Ig) molecule binding to one species form of VEGF may cross-react with VEGF, which has a different sequence than the human one, from one or more other species. For example immunoglobulin (Ig) molecules binding to human VEGF may exhibit cross reactivity with VEGF from one or more other species of primates and/or with VEGF from one or more species of animals that are used in animal models for diseases, for example monkey, mouse, rat, rabbit, pig, dog, and in particular in animal models for diseases and disorders associated with VEGF-mediated effects on angiogenesis (such as the species and animal models mentioned herein). Immunoglobulin (Ig) molecules that show such cross-reactivity are advantageous in a research and/or drug development, since it allows the immunoglobulin single variable domains of the invention to be tested in acknowledged disease models such as monkeys, in particular Cynomolgus or Rhesus, or mice and rats.

Preferably, in view of cross-reactivity with one or more VEGF molecules from species other than human that is/are intended for use as an animal model during development of a therapeutic VEGF antagonist, a VEGF-binding component recognizes an epitope in a region of the VEGF of interest that has a high degree of identity with human VEGF.

Hence, the VEGF-binding components of the binding molecule according to the invention, e.g. an immunoglobulin (Ig) molecule recognizes an epitope which is, totally or in part, located in a region of VEGF that is relevant for binding to its receptor. According to preferred aspects, the VEGF-binding components of the binding molecule according to the invention block VEGF receptor activation, preferably substantially and most preferably totally.

As described above, the ability of a VEGF-binding component to block the interaction between VEGF and its receptors can be determined by an Amplified Luminescent Proximity Homogeneous Assay (AlphaScreen®), a competition ELISA, or a plasmon resonance (SPR) based assay (Biacore®), as described in the Examples.

TrkB & VEGF Binding Molecules

The present invention relates to binding molecules that have binding specificities for at least two different targets. In relation to the present invention, the binding molecules are derived from antibodies. Techniques for making binding molecules include, but are not limited to, recombinant co-expression of two immunoglobulin heavy chain-light chain pairs having different specificities (see Milstein and Cuello, Nature 305: 537 (1983)), WO 93/08829, and Traunecker et al., EMBO J. 10: 3655 (1991)), and "knob-in-hole" engineering (see, e.g., U.S. Pat. No. 5,731,168). Binding molecules of the invention may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., Science, 229: 81 (1985)); using leucine zippers to produce bi-specific antibodies (see, e.g., Kostelny et al., Immunol., 148(5): 1547-1553 (1992)); using "diabody" technology for making bispecific antibody fragments (see, e.g., Hollinger et al., Proc. Natl. Acad. Sci. USA, 90:6444-6448 (1993)); and using single-chain Fv (sFv) dimers (see, e.g. Gruber et al., /. Immunol., 152:5368 (1994)); and preparing trispecific antibodies as described, e.g., in Tutt et al. /. Immunol. 147: 60 (1991).

In one embodiment, the binding molecule comprises or consists of at least one antigen binding site that binds specifically to Vascular Endothelial Growth Factor (VEGF), preferably VEGF-A and at least one antigen binding site that binds specifically to Tropomyosin receptor kinase B (TrkB). In a related embodiment, the binding molecule is bispecific and tetravalent.

In another embodiment, the binding molecule comprises or consists of at least one antigen binding site that binds specifically to Vascular Endothelial Growth Factor (VEGF) and at least one antigen binding site that binds specifically to Tropomyosin receptor kinase B (TrkB), wherein the at least one antigen binding site that binds specifically to VEGF is an immunoglobulin (Ig) molecule, preferably an IgG molecule. In a related embodiment, the binding molecule is bispecific and tetravalent.

In another embodiment, the binding molecule comprises or consists of at least one antigen binding site that binds specifically to Vascular Endothelial Growth Factor (VEGF) and at least one antigen binding site that binds specifically to Tropomyosin receptor kinase B (TrkB), wherein the at least one antigen binding site that binds specifically to TrkB comprises one or more scFv(s), preferably in a VL-VH orientation from N- to C-terminus. In a related embodiment, the binding molecule is bispecific and tetravalent.

In another embodiment, the binding molecule comprises or consists of at least one antigen binding site that binds specifically to Vascular Endothelial Growth Factor (VEGF) and at least one antigen binding site that binds specifically to Tropomyosin receptor kinase B (TrkB), wherein the at least one antigen binding site that binds specifically to VEGF is an immunoglobulin (Ig) molecule, preferably an IgG molecule, and wherein the at least one antigen binding site that binds specifically to TrkB is fused to the C-terminus of the heavy chain of the Ig molecule. In a related embodiment, the binding molecule is bispecific and tetravalent.

In another embodiment, the binding molecule comprises or consists of at least one antigen binding site that binds specifically to Vascular Endothelial Growth Factor (VEGF) and at least one antigen binding site that binds specifically to Tropomyosin receptor kinase B (TrkB), wherein the at least one antigen binding site that binds specifically to VEGF is an immunoglobulin (Ig) molecule, preferably an IgG molecule, and wherein the at least one antigen binding site that binds specifically to TrkB comprises one or more scFv(s), preferably in a VL-VH orientation from N- to C-terminus. In a related embodiment, the binding molecule is bispecific and tetravalent.

In another embodiment, the binding molecule comprises or consists of at least one antigen binding site that binds specifically to Vascular Endothelial Growth Factor (VEGF) and at least one antigen binding site that binds specifically to Tropomyosin receptor kinase B (TrkB), wherein the at least one antigen binding site that binds specifically to VEGF is an immunoglobulin (Ig) molecule, preferably an IgG molecule, and wherein the at least one antigen binding site that binds specifically to TrkB comprises one or more scFv(s), preferably in a VL-VH orientation from N- to C-terminus, and is fused to the C-terminus of the heavy chain of the Ig molecule. In a related embodiment, the binding molecule is bispecific and tetravalent.

In a preferred embodiment, the binding molecules of the invention comprise or consists of (i) two heavy chains each comprising or consisting of a heavy chain variable region specific for VEGF, constant IgG domains and an scFv specific for TrkB and (ii) two light chains each comprising or consisting of a light chain variable region specific for VEGF.

In addition, these single chain Fv fragments might be further stabilized by incorporation of disulfide bonds between the VH and VL domains, within the VH domain, or within the VL domain, via incorporation of cysteine residues. The term N-terminus denotes the first amino acid of the polypeptide chain while the term C-terminus denotes the last amino acid of the C-terminus of the polypeptide chain. Hence an embodiment of the invention is wherein the one or more scFv(s) comprises additional cysteine residues to form disulfide bonds.

In one embodiment, the present invention provides a binding molecule which is a multi-specific binding protein comprising (i) an Ig molecule specifically binding to VEGF with two heavy and two light chains, and (ii) two scFv molecules (scFv(s)) each specifically binding to TrkB. Preferably, each heavy chain of the Ig molecule has one scFv fused to its C-terminus, thereby forming a bispecific tetravalent binding protein.

In one embodiment, the present invention provides a binding molecule (also referred to herein multi-specific binding protein or a modified Ig molecule) with:
(i) two heavy chains, each comprising from N to C terminus:
   a heavy chain variable domain specific for VEGF (e.g., murine, humanized or human VH domain)
   constant domains of an IgG (e.g. human IgG1 or IgG4)
   a peptide linker (e.g. a GS mini linker) and
   an scFv specific for TrkB (e.g. an scFv comprising from N to C terminus a VH domain (e.g. murine, humanized or human VH domain) a linker and a VL domain (e.g. murine, humanized or human VL domain), or vice versa a VL domain a linker and a VH domain); and
(ii) two light chains, each comprising from N to C-terminus:
   a light chain variable domain specific for VEGF (e.g. murine, humanized or human VL domain),
   a light chain constant domain (e.g., a human kappa chain).

The present invention provides a binding molecule having at least one antigen binding site that binds specifically to vascular endothelial growth factor (VEGF) and at least one antigen binding site that binds specifically to Tropomyosin receptor kinase B (TrkB).

Methods of preparing binding sites that bind to specific target antigens are well known in the art. The skilled person can readily use these methods to devise an antigen binding site having the necessary specificity for the VEGF or TrkB target antigens.

Methods of generating antibodies and antibody fragments are well known in the art. For example, antibodies may be generated via any one of several methods which employ induction of in vivo production of antibody molecules, screening of immunoglobulin libraries (Orlandi et al, 1989. Proc. Natl. Acad. Sci. U.S.A. 86:3833-3837; Winter et al 1991, Nature 349:293-299) or generation of monoclonal antibody molecules by cell lines in culture. These include, but are not limited to, the hybridoma technique, the human B-cell hybridoma technique, and the Epstein-Barr virus (EBV)-hybridoma technique (Kohler et al 1975. Nature 256:4950497; Kozbor et al 1985. J. Immunol. Methods 81:31-42; Cote et al 1983. Proc. Natl. Acad. Sci. USA 80:2026-2030; Cole et al 1984. Mol. Cell. Biol. 62:109-120).

Using methods known in the art and described herein it would be routine for the person skilled in the art to prepare antibodies having a binding site with the necessary specificity for the VEGF and/or TrkB target antigens as well as binding molecules described herein. Isolation of the binding domains from such antibodies is a routine practice and indeed further information on methods that can be used to generate antibodies and binding molecules as described herein are provided in the accompanying examples.

The present inventors conceived binding molecules against VEGF/TrkB of the invention as shown in Table 1 and a selection of those molecules were prepared and are discussed in the accompanying examples.

TABLE 1

| Binding Molecule | Sequence | SEQ ID NO: |
|---|---|---|
| TPP-11735 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 1 |
| TPP-11735 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL | 2 |

TABLE 1-continued

| Binding Molecule | Sequence | SEQ ID NO: |
|---|---|---|
|  | HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSEVQLVESGGGLVQPGGSLRLSCA ASGFTINASWIHWVRQAPGKGLEWVGAIYPYSGYTNYADSVKGRF TISADTSKNTAYLQMNSLRAEDTAVYYCARWGHSTSPWAMDYWGQ GTLVTVSSGGSEGKSSGSGSESKSTGGSDIQMTQSPSSLSASVGD RVTITCRASQVIRRSLAWYQQKPGKAPKLLIYAASNLASGVPSRF SGSGSGTDFTLTISSLQPEDFATYYCQQSNTSPLTFGQGTKVEIK |  |
| TPP-11736 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 3 |
| TPP-11736 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSDIQMTQSPSSLSASVGDRVTITC RASQVIRRSLAWYQQKPGKAPKLLIYAASNLASGVPSRFSGSGSG TDFTLTISSLQPEDFATYYCQQSNTSPLTFGQGTKVEIKGGSEGK SSGSGSESKSTGGSEVQLVESGGGLVQPGGSLRLSCAASGFTINA SWIHWVRQAPGKGLEWVGAIYPYSGYTNYADSVKGRFTISADTSK NTAYLQMNSLRAEDTAVYYCARWGHSTSPWAMDYWGQGTLVTVSS | 4 |
| TPP-11737 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 5 |
| TPP-11737 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSEVQLVESGGGLVQPGGSLRLSCA ASGFTISDYWIHWVRQAPGKGLEWVAGITPAGGYTYYADSVKGRF TISADTSKNTAYLQMNSLRAEDTAVYYCARFVFFLPYAMDYWGQG TLVTVSSGGSEGKSSGSGSESKSTGGSDIQMTQSPSSLSASVGDR VTITCRASQDVSTAVAWYQQKPGKAPKLLTYSASFLYSGVPSRFS GSGSGTDFTLTISSLQPEDFATYYCQQSYTTPPTFGQGTKVEIK | 6 |
| TPP-11738 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 7 |
| TPP-11738 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSDIQMTQSPSSLSASVGDRVTITC RASQDVSTAVAWYQQKPGKAPKLLIYSASFLYSGVPSRFSGSGSG TDFTLTISSLQPEDFATYYCQQSYTTPPTFGQGTKVEIKGGSEGK SSGSGSESKSTGGSEVQLVESGGGLVQPGGSLRLSCAASGFTISD YWIHWVRQAPGKGLEWVAGITPAGGYTYYADSVKGRFTISADTSK NTAYLQMNSLRAEDTAVYYCARFVFFLPYAMDYWGQGTLVTVSS | 8 |

TABLE 1-continued

| Binding Molecule | Sequence | SEQ ID NO: |
|---|---|---|
| TPP-14936 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPPTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 9 |
| TPP-14936 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSEVQLVESGGGLVQPGGSLRLSCA ASGYDFTHYGMNWVRQAPGKGLEWVGWINTYTGEPTYAADFKRRF TFSLDTSKSTAYLQMNSLRAEDTAVYYCAKYPYYYGTSHWYFDVW GQGTLVTVSSGGSEGKSSGSGSESKSTGGSDIQLTQSPSSLSASV GDRVTITCSASQDISNYLNWYQQKPGKAPKVLIYFTSSLHSGVPS RFSGSGSGTDFTLTISSLQPEDFATYYCQQYSTVPWTFGQGTKVE IK | 10 |
| TPP-14937 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPPTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 11 |
| TPP-14937 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSDIQLTQSPSSLSASVGDRVTITC SASQDISNYLNWYQQKPGKAPKVLIYFTSSLHSGVPSRFSGSGSG TDFTLTISSLQPEDFATYYCQQYSTVPWTFGQGTKVEIKGGSEGK SSGSGSGSESKSTGGSEVQLVESGGGLVQPGGSLRLSCAASGYDFTH YGMNWVRQAPGKGLEWVGWINTYTGEPTYAADFKRRFTFSLDTSK STAYLQMNSLRAEDTAVYYCAKYPYYYGTSHWYFDVWGQGTLVTV SS | 12 |
| TPP-16061 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPPTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 13 |
| TPP-16061 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RASQVIRRSLAWYQQKPGKAPKLLIYAASNLASGVPSRFSGSGSG TDFTLTISSLQPEDFATYYCQQSNTSPLTFGQGTKVEIKGGSEGK SSGSGSESKSTGGSEVQLVESGGGLVQPGGSLRLSCAASGFTINA SWIHWVRQAPGKGLEWVGAIYPYSGYTNYADSVKGRFTISADTSK NTAYLQMNSLRAEDTAVYYCARWGHSTSPWAMDYWGQGTLVTVSS | 14 |
| TPP-16062 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPPTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 15 |

TABLE 1-continued

| Binding Molecule | Sequence | SEQ ID NO: |
|---|---|---|
| TPP-16062 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSDIQMTQSPSSLSASVGDRVTITCRASQV IRRSLAWYQQKPGKAPKLLIYAASNLASGVPSRFSGSGSGTDFTL TISSLQPEDFATYYCQQSNTSPLTFGQGTKVEIKGGSEGKSSGSG SESKSTGGSEVQLVESGGGLVQPGGSLRLSCAASGFTINASWIHW VRQAPGKGLEWVGAIYPYSGYTNYADSVKGRFTISADTSKNTAYL QMNSLRAEDTAVYYCARWGHSTSPWAMDYWGQGTLVTVSS | 16 |
| TPP-16063 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 17 |
| TPP-16063 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRASQVIRRSL AWYQQKPGKAPKLLIYAASNLASGVPSRFSGSGSGTDFTLTISSL QPEDFATYYCQQSNTSPLTFGQGTKVEIKGGSEGKSSGSGSESKS TGGSEVQLVESGGGLVQPGGSLRLSCAASGFTINASWIHWVRQAP GKGLEWVGAIYPYSGYTNYADSVKGRFTISADTSKNTAYLQMNSL RAEDTAVYYCARWGHSTSPWAMDYWGQGTLVTVSS | 18 |
| TPP-16064 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 19 |
| TPP-16064 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSGGSDIQMTQSPSSLSASVGDRVTITCRASQVIRRSLAWYQ QKPGKAPKLLIYAASNLASGVPSRFSGSGSGTDFTLTISSLQPED FATYYCQQSNTSPLTFGQGTKVEIKGGSEGKSSGSGSESKSTGGS EVQLVESGGGLVQPGGSLRLSCAASGFTINASWIHWVRQAPGKGL EWVGAIYPYSGYTNYADSVKGRFTISADTSKNTAYLQMNSLRAED TAVYYCARWGHSTSPWAMDYWGQGTLVTVSS | 20 |
| TPP-19984 Light Chain | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 21 |
| TPP-19984 Heavy Chain | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD | 22 |

TABLE 1-continued

| Binding Molecule | Sequence | SEQ ID NO: |
|---|---|---|
| | SDGSFFLYSKLTVDKSRWQQGNVFSCSVMHEALHNHYTQKSLSLS<br>PGGGGGSGGGGSEVQLVESGGGLVQPGGSLRLSCAASGYDFTHYG<br>MNWVRQAPGKGLEWVGWINTYTGEPTYAADFKRRFTFSLDTSKST<br>AYLQMNSLRAEDTAVYYCAKYPYYYGTSHWYFDVWGQGTLVTVSS<br>GGSEGKSSGSGSESKSTGGSDIQLTQSPSSLSASVGDRVTITCSA<br>SQDISNYLNWYQQKPGKAPKVLIYFTSSLHSGVPSRFSGSGSGTD<br>FTLTISSLQPEDFATYYCQQYSTVPWTFGQGTKVEIK | |
| TPP-19985<br>Light Chain | DIQMTQSPSSLSASVGDRVTITCRTSENVYSNLAWYQQKPGKAPK<br>LLIYAASNLQSGVPSRFSGSGSGTDYTFTISSLQPEDIATYYCQH<br>FWGSPFTFGQGTKLEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 23 |
| TPP-19985<br>Heavy Chain | QVQLVQSGAEVKKPGASVKVSCKASGYTFTNYDIIWVRQAPGQGL<br>EWMGYINPYNDGTKYNEKFKGRVTMTRDTSTSTVYMELSSLRSED<br>TAVYYCARLLKYRRFRYYAIDYWGQGTTVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSEVQLVESGGGLVQPGGSLRLSCA<br>ASGYDFTHYGMNWVRQAPGKGLEWVGWINTYTGEPTYAADFKRRF<br>TFSLDTSKSTAYLQMNSLRAEDTAVYYCAKYPYYYGTSHWYFDVW<br>GQGTLVTVSSGGSEGKSSGSGSESKSTGGSDIQLTQSPSSLSASV<br>GDRVTITCSASQDISNYLNWYQQKPGKAPKVLIYFTSSLHSGVPS<br>RFSGSGSGTDFTLTISSLQPEDFATYYCQQYSTVPWTFGQGTKVE<br>IK | 24 |
| TPP-14938<br>Light Chain | DIQMTQSPSSLSASVGDRVTITCRASQVIRRSLAWYQQKPGKAPK<br>LLIYAASNLASGVPSRFSGSGSGTDFTLTISSLQPEDFATYYCQQ<br>SNTSPLTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 25 |
| TPP-14938<br>Heavy Chain | EVQLVESGGGLVQPGGSLRLSCAASGFTINASWIHWVRQAPGKGL<br>EWVGAIYPYSGYTNYADSVKGRFTISADTSKNTAYLQMNSLRAED<br>TAVYYCARWGHSTSPWAMDYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEAAGGPSVFLFPPKPKDTLMISRTPEVTCVVVDV<br>SHEDPEVKFNWYVDGVEVHNAKTKPREEQYNSTYRVVSVLTVLHQ<br>DWLNGKEYKCKVSNKALPAPIEKTISKAKGQPREPQVYTLPPSRE<br>EMTKNQVSLTCLVKGFYPSDIAVEWESNGQPENNYKTTPPVLDSD<br>GSFFLYSKLTVDKSRWQQGNVFSCSVMHEALHNHYTQKSLSLSPG<br>GGSEGKSSGSGSESKSTGGSQVQLVQSGAEVKKPGASVKVSCKAS<br>GYTFTNYDIIWVRQAPGQGLEWMGYINPYNDGTKYNEKFKGRVTM<br>TRDTSTSTVYMELSSLRSEDTAVYYCARLLKYRRFRYYAIDYWGQ<br>GTTVTVSSGGSEGKSSGSGSESKSTGGSDIQMTQSPSSLSASVGD<br>RVTITCRTSENVYSNLAWYQQKPGKAPKLLIYAASNLQSGVPSRF<br>SGSGSGTDYTFTISSLQPEDIATYYCQHFWGSPFTFGQGTKLEIK | 26 |
| TPP-14939<br>Light Chain | DIQMTQSPSSLSASVGDRVTITCRASQVIRRSLAWYQQKPGKAPK<br>LLIYAASNLASGVPSRFSGSGSGTDFTLTISSLQPEDFATYYCQQ<br>SNTSPLTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 27 |
| TPP-14939<br>Heavy Chain | EVQLVESGGGLVQPGGSLRLSCAASGFTINASWIHWVRQAPGKGL<br>EWVGAIYPYSGYTNYADSVKGRFTISADTSKNTAYLQMNSLRAED<br>TAVYYCARWGHSTSPWAMDYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEAAGGPSVFLFPPKPKDTLMISRTPEVTCVVVDV<br>SHEDPEVKFNWYVDGVEVHNAKTKPREEQYNSTYRVVSVLTVLHQ<br>DWLNGKEYKCKVSNKALPAPIEKTISKAKGQPREPQVYTLPPSRE<br>EMTKNQVSLTCLVKGFYPSDIAVEWESNGQPENNYKTTPPVLDSD<br>GSFFLYSKLTVDKSRWQQGNVFSCSVMHEALHNHYTQKSLSLSPG<br>GGSEGKSSGSGSESKSTGGSDIQMTQSPSSLSASVGDRVTITCRT<br>SENVYSNLAWYQQKPGKAPKLLIYAASNLQSGVPSRFSGSGSGTD<br>YTFTISSLQPEDIATYYCQHFWGSPFTFGQGTKLEIKGGSEGKSS<br>GSGSESKSTGGSQVQLVQSGAEVKKPGASVKVSCKASGYTFTNYD<br>IIWVRQAPGQGLEWMGYINPYNDGTKYNEKFKGRVTMTRDTSTST<br>VYMELSSLRSEDTAVYYCARLLKYRRFRYYAIDYWGQGTTVTVSS | 28 |

TABLE 1-continued

| Binding Molecule | Sequence | SEQ ID NO: |
|---|---|---|
| TPP-14940 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 29 |
| TPP-14940 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSQVQLVQSGAEVKKPGASVKVSCK ASGYTFTNYDIIWVRQAPGQGLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGQGTKLE IK | 30 |
| TPP-14941 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 31 |
| TPP-14941 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGSEGKSSGSGSESKSTGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGQGTKLEIKGGSEGK SSGSGSESKSTGGSQVQLVQSGAEVKKPGASVKVSCKASGYTFTN YDIIWVRQAPGQGLEWMGYINPYNDGTKYNEKFKGRVTMTRDTST STVYMELSSLRSEDTAVYYCARLLKYRRFRYYAIDYWGQGTTVTV SS | 32 |
| TPP-19986 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 33 |
| TPP-19986 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQGLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGQGTKLEIK | 34 |
| TPP-19987 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 35 |

TABLE 1-continued

| Binding Molecule | Sequence | SEQ ID NO: |
|---|---|---|
| TPP-19987 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQGLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGQGTKLE IK | 36 |
| TPP-19988 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 37 |
| TPP-19988 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGQGTKLEIKGGSEGKSSGSGSESKS TGGSQVQLVQSGAEVKKPGASVKVSCKASGYTFTNYDIIWVRQAP GQGLEWMGYINPYNDGTKYNEKFKGRVTMTRDTSTSTVYMELSSL RSEDTAVYYCARLLKYRRFRYYAIDYWGQGTTVTVSS | 38 |
| TPP-19989 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 39 |
| TPP-19989 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGQGTKLEIKGGSEGK SSGSGSESKSTGGSQVQLVQSGAEVKKPGASVKVSCKASGYTFTN YDIIWVRQAPGQGLEWMGYINPYNDGTKYNEKFKGRVTMTRDTST STVYMELSSLRSEDTAVYYCARLLKYRRFRYYAIDYWGQGTTVTV SS | 40 |
| TPP-22171 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 41 |
| TPP-22171 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV | 42 |

TABLE 1-continued

| Binding Molecule | Sequence | SEQ ID NO: |
|---|---|---|
| | DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSQVQLVQSGAEVKKPGASVKVSCKASGYTFTNYD<br>IIWVRQAPGQCLEWMGYINPYNDGTKYNEKFKGRVTMTRDTSTST<br>VYMELSSLRSEDTAVYYCARLLKYRRFRYYAIDYWGQGTTVTVSS<br>GGSEGKSSGSGSESKSTGGSDIQMTQSPSSLSASVGDRVTITCRT<br>SENVYSNLAWYQQKPGKAPKLLIYAASNLQSGVPSRFSGSGSGTD<br>YTFTISSLQPEDIATYYCQHFWGSPFTFGCGTKLEIK | |
| TPP-22172<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 43 |
| TPP-22172<br>Heavy Chain | EVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQCLEWMGYINPYNDGTKYNEKFKGRV<br>TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGCGTKLE<br>IK | 44 |
| TPP-22173<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 45 |
| TPP-22173<br>Heavy Chain | EVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSDIQMTQSPSSLSASVGDRVTITCRTSENVYSNL<br>AWYQQKPGKAPKLLIYAASNLQSGVPSRFSGSGSGTDYTFTISSL<br>QPEDIATYYCQHFWGSPFTFGCGTKLEIKGGSEGKSSGSGSESKS<br>TGGSQVQLVQSGAEVKKPGASVKVSCKASGYTFTNYDIIWVRQAP<br>GQCLEWMGYINPYNDGTKYNEKFKGRVTMTRDTSTSTVYMELSSL<br>RSEDTAVYYCARLLKYRRFRYYAIDYWGQGTTVTVSS | 46 |
| TPP-22174<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 47 |
| TPP-22174<br>Heavy Chain | EVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGCGTKLEIKGGSEGK<br>SSGSGSGSESKSTGGSQVQLVQSGAEVKKPGASVKVSCKASGYTFTN | 48 |

TABLE 1-continued

| Binding Molecule | Sequence | SEQ ID NO: |
|---|---|---|
| | YDIIWVRQAPGQCLEWMGYINPYNDGTKYNEKFKGRVTMTRDTST<br>STVYMELSSLRSEDTAVYYCARLLKYRRFRYYAIDYWGQGTTVTV<br>SS | |
| TPP-22175<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 49 |
| TPP-22175<br>Heavy Chain | QVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSQVQLVQSGAEVKKPGASVKVSCKASGYTFTNYD<br>IIWVRQAPGQGLEWMGYINPYNDGTKYNEKFKGRVTMTRDTSTST<br>VYMELSSLRSEDTAVYYCARLLKYRRFRYYAIDYWGQGTTVTVSS<br>GGSEGKSSGSGSESKSTGGSDIQMTQSPSSLSASVGDRVTITCRT<br>SENVYSNLAWYQQKPGKAPKLLIYAASNLQSGVPSRFSGSGSGTD<br>YTFTISSLQPEDIATYYCQHFWGSPFTFGQGTKLEIK | 50 |
| TPP-22176<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 51 |
| TPP-22176<br>Heavy Chain | EVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSQVQLVQSGAEVKKPGASVKVSCKASGYTFTNYD<br>IIWVRQAPGQGLEWMGYINPYNDGTKYNEKFKGRVTMTRDTSTST<br>VYMELSSLRSEDTAVYYCARLLKYRRFRYYAIDYWGQGTTVTVSS<br>GGSEGKSSGSGSESKSTGGSDIQMTQSPSSLSASVGDRVTITCRT<br>SENVYSNLAWYQQKPGKAPKLLIYAASNLQSGVPSRFSGSGSGTD<br>YTFTISSLQPEDIATYYCQHFWGSPFTFGQGTKLEIK | 52 |
| TPP-22177<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 53 |
| TPP-22177<br>Heavy Chain | EVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSQVQLVQSGAEVKKPGASVKVSCKASGYTFTNYD<br>IIWVRQAPGQGLEWMGYINPYNDGTKYNEKFKGRVTMTRDTSTST<br>VYMELSSLRSEDTAVYYCARLLKYRRFRYYAIDYWGQGTTVTVSS<br>GGSEGKSSGSGSESKSTGGSDIQMTQSPSSLSASVGDRVTITCRT<br>SENVYSNLAWYQQKPGKAPKLLIYAASNLQSGVPSRFSGSGSGTD<br>YTFTISSLQPEDIATYYCQHFWGSPFTFGQGTKLEIK | 54 |
| TPP-22178<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 55 |

TABLE 1-continued

| Binding Molecule | Sequence | SEQ ID NO: |
|---|---|---|
| TPP-22178 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQGLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGQGTKLEIK | 56 |
| TPP-22179 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 57 |
| TPP-22179 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQGLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGQGTKLEIK | 58 |
| TPP-22180 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 59 |
| TPP-22180 Heavy Chain | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQGLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGQGTKLEIK | 60 |
| TPP-22181 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 61 |
| TPP-22181 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS | 62 |

TABLE 1-continued

| Binding Molecule | Sequence | SEQ ID NO: |
|---|---|---|
| | REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQGLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGQGTKLE IK | |
| TPP-22182 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 63 |
| TPP-22182 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQGLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGQGTKLE IK | 64 |
| TPP-22183 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 65 |
| TPP-22183 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQGLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGQGTKLE IK | 66 |
| TPP-22184 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 67 |
| TPP-22184 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQGLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV | 68 |

TABLE 1-continued

| Binding Molecule | Sequence | SEQ ID NO: |
| --- | --- | --- |
| | GDRVTITCRTSENVYSNLAWYQQKPGKAPKLLIYAASNLQSGVPS<br>RFSGSGSGTDYTFTISSLQPEDIATYYCQHFWGSPFTFGQGTKLE<br>IK | |
| TPP-22185<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 69 |
| TPP-22185<br>Heavy Chain | EVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQGLEWMGYINPYNDGTKYNEKFKGRV<br>TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGQGTKLE<br>IK | 70 |
| TPP-22186<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 71 |
| TPP-22186<br>Heavy Chain | QVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQGLEWMGYINPYNDGTKYNEKFKGRV<br>TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGQGTKLE<br>IK | 72 |
| TPP-22187<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 73 |
| TPP-22187<br>Heavy Chain | QVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSDIQMTQSPSSLSASVGDRVTITCRTSENVYSNL<br>AWYQQKPGKAPKLLIYAASNLQSGVPSRFSGSGSGTDYTFTISSL<br>QPEDIATYYCQHFWGSPFTFGQGTKLEIKGGSEGKSSGSGSESKS<br>TGGSQVQLVQSGAEVKKPGASVKVSCKASGYTFTNYDIIWVRQAP<br>GQGLEWMGYINPYNDGTKYNEKFKGRVTMTRDTSTSTVYMELSSL<br>RSEDTAVYYCARLLKYRRFRYYAIDYWGQGTTVTVSS | 74 |

TABLE 1-continued

| Binding Molecule | Sequence | SEQ ID NO: |
| --- | --- | --- |
| TPP-22188 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 75 |
| TPP-22188 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGQGTKLEIKGGSEGKSSGSGSESKS TGGSQVQLVQSGAEVKKPGASVKVSCKASGYTFTNYDIIWVRQAP GQGLEWMGYINPYNDGTKYNEKFKGRVTMTRDTSTSTVYMELSSL RSEDTAVYYCARLLKYRRFRYYAIDYWGQGTTVTVSS | 76 |
| TPP-22189 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 77 |
| TPP-22189 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGQGTKLEIKGGSEGKSSGSGSESKS TGGSQVQLVQSGAEVKKPGASVKVSCKASGYTFTNYDIIWVRQAP GQGLEWMGYINPYNDGTKYNEKFKGRVTMTRDTSTSTVYMELSSL RSEDTAVYYCARLLKYRRFRYYAIDYWGQGTTVTVSS | 78 |
| TPP-22190 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 79 |
| TPP-22190 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGQGTKLEIKGGSEGKSSGSGSESKS TGGSQVQLVQSGAEVKKPGASVKVSCKASGYTFTNYDIIWVRQAP GQGLEWMGYINPYNDGTKYNEKFKGRVTMTRDTSTSTVYMELSSL RSEDTAVYYCARLLKYRRFRYYAIDYWGQGTTVTVSS | 80 |
| TPP-22191 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 81 |

TABLE 1-continued

| Binding Molecule | Sequence | SEQ ID NO: |
|---|---|---|
| TPP-22191 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGQGTKLEIKGGSEGKSSGSGSESKS TGGSQVQLVQSGAEVKKPGASVKVSCKASGYTFTNYDIIWVRQAP GQGLEWMGYINPYNDGTKYNEKFKGRVTMTRDTSTSTVYMELSSL RSEDTAVYYCARLLKYRRFRYYAIDYWGQGTTVTVSS | 82 |
| TPP-22192 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 83 |
| TPP-22192 Heavy Chain | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGQGTKLEIKGGSEGKSSGSGSESKS TGGSQVQLVQSGAEVKKPGASVKVSCKASGYTFTNYDIIWVRQAP GQGLEWMGYINPYNDGTKYNEKFKGRVTMTRDTSTSTVYMELSSL RSEDTAVYCARLLKYRRFRYYAIDYWGQGTTVTVSS | 84 |
| TPP-22193 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 85 |
| TPP-22193 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGQGTKLEIKGGSEGK SSGSGSESKSTGGSQVQLVQSGAEVKKPGASVKVSCKASGYTFTN YDIIWVRQAPGQGLEWMGYINPYNDGTKYNEKFKGRVTMTRDTST STVYMELSSLRSEDTAVYYCARLLKYRRFRYYAIDYWGQGTTVTV SS | 86 |
| TPP-22194 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 87 |
| TPP-22194 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL | 88 |

TABLE 1-continued

| Binding Molecule | Sequence | SEQ ID NO: |
|---|---|---|
| | HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGQGTKLEIKGGSEGK<br>SSGSGSESKSTGGSQVQLVQSGAEVKKPGASVKVSCKASGYTFTN<br>YDIIWVRQAPGQGLEWMGYINPYNDGTKYNEKFKGRVTMTRDTST<br>STVYMELSSLRSEDTAVYYCARLLKYRRFRYYAIDYWGQGTTVTV<br>SS | |
| TPP-22195<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 89 |
| TPP-22195<br>Heavy Chain | EVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGQGTKLEIKGGSEGK<br>SSGSGSESKSTGGSQVQLVQSGAEVKKPGASVKVSCKASGYTFTN<br>YDIIWVRQAPGQGLEWMGYINPYNDGTKYNEKFKGRVTMTRDTST<br>STVYMELSSLRSEDTAVYYCARLLKYRRFRYYAIDYWGQGTTVTV<br>SS | 90 |
| TPP-22196<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 91 |
| TPP-22196<br>Heavy Chain | QVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGQGTKLEIKGGSEGK<br>SSGSGSESKSTGGSQVQLVQSGAEVKKPGASVKVSCKASGYTFTN<br>YDIIWVRQAPGQGLEWMGYINPYNDGTKYNEKFKGRVTMTRDTST<br>STVYMELSSLRSEDTAVYYCARLLKYRRFRYYAIDYWGQGTTVTV<br>SS | 92 |
| TPP-22197<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 93 |
| TPP-22197<br>Heavy Chain | EVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGQGTKLEIKGGSEGK | 94 |

TABLE 1-continued

| Binding Molecule | Sequence | SEQ ID NO: |
|---|---|---|
| | SSGSGSESKSTGGSQVQLVQSGAEVKKPGASVKVSCKASGYTFTN YDIIWVRQAPGQGLEWMGYINPYNDGTKYNEKFKGRVTMTRDTST STVYMELSSLRSEDTAVYYCARLLKYRRFRYYAIDYWGQGTTVTV SS | |
| TPP-22198 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 95 |
| TPP-22198 Heavy Chain | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGQGTKLEIKGGSEGK SSGSGSESKSTGGSQVQLVQSGAEVKKPGASVKVSCKASGYTFTN YDIIWVRQAPGQGLEWMGYINPYNDGTKYNEKFKGRVTMTRDTST STVYMELSSLRSEDTAVYYCARLLKYRRFRYYAIDYWGQGTTVTV SS | 96 |
| TPP-22199 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 97 |
| TPP-22199 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQCLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGCGTKLEIK | 98 |
| TPP-22200 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 99 |
| TPP-22200 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGSGGGGSQVQLVQSGAEVKKPGASVKVSCKASGYTFTNYD IIWVRQAPGQCLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGCGTKLEIK | 100 |

TABLE 1-continued

| Binding Molecule | Sequence | SEQ ID NO: |
|---|---|---|
| TPP-22201 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 101 |
| TPP-22201 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQCLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGCGTKLEIK | 102 |
| TPP-22202 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 103 |
| TPP-22202 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQCLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGCGTKLEIK | 104 |
| TPP-22203 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 105 |
| TPP-22203 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQCLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGCGTKLEIK | 106 |
| TPP-22204 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 107 |

TABLE 1-continued

| Binding Molecule | Sequence | SEQ ID NO: |
| --- | --- | --- |
| TPP-22204 Heavy Chain | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSQVQLVQSGAEVKKPGASVKVSCKASGYTFTNYD IIWVRQAPGQCLEWMGYINPYNDGTKYNEKFKGRVTMTRDTSTST VYMELSSLRSEDTAVYYCARLLKYRRFRYYAIDYWGQGTTVTVSS GGSEGKSSGSGSESKSTGGSDIQMTQSPSSLSASVGDRVTITCRT SENVYSNLAWYQQKPGKAPKLLIYAASNLQSGVPSRFSGSGSGTD YTFTISSLQPEDIATYYCQHFWGSPFTFGCGTKLEIK | 108 |
| TPP-22205 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 109 |
| TPP-22205 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQCLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGCGTKLE IK | 110 |
| TPP-22206 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 111 |
| TPP-22206 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSQVQLVQSGAEVKKPGASVKVSCK ASGYTFTNYDIIWVRQAPGQCLEWMGYINPYNDGTKYNEKFKGRV TMTRDTSTSTVYMELSSLRSEDTAVYYCARLLKYRRFRYYAIDYW GQGTTVTVSSGGSEGKSSGSGSESKSTGGSDIQMTQSPSSLSASV GDRVTITCRTSENVYSNLAWYQQKPGKAPKLLIYAASNLQSGVPS RFSGSGSGTDYTFTISSLQPEDIATYYCQHFWGSPFTFGCGTKLE IK | 112 |
| TPP-22207 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 113 |
| TPP-22207 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV | 114 |

TABLE 1-continued

| Binding Molecule | Sequence | SEQ ID NO: |
|---|---|---|
| | DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQCLEWMGYINPYNDGTKYNEKFKGRV<br>TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGCGTKLE<br>IK | |
| TPP-22208<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 115 |
| TPP-22208<br>Heavy Chain | QVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQCLEWMGYINPYNDGTKYNEKFKGRV<br>TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGCGTKLE<br>IK | 116 |
| TPP-22209<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 117 |
| TPP-22209<br>Heavy Chain | EVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQCLEWMGYINPYNDGTKYNEKFKGRV<br>TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGCGTKLE<br>IK | 118 |
| TPP-22210<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 119 |
| TPP-22210<br>Heavy Chain | QVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSQVQLVQSGAEVKKPGASVKVSCK<br>ASGYTFTNYDIIWVRQAPGQCLEWMGYINPYNDGTKYNEKFKGRV | 120 |

TABLE 1-continued

| Binding Molecule | Sequence | SEQ ID NO: |
|---|---|---|
| | TMTRDTSTSTVYMELSSLRSEDTAVYYCARLLKYRRFRYYAIDYW<br>GQGTTVTVSSGGSEGKSSGSGSESKSTGGSDIQMTQSPSSLSASV<br>GDRVTITCRTSENVYSNLAWYQQKPGKAPKLLIYAASNLQSGVPS<br>RFSGSGSGTDYTFTISSLQPEDIATYYCQHFWGSPFTFGCGTKLE<br>IK | |
| TPP-22211<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 121 |
| TPP-22211<br>Heavy Chain | QVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSDIQMTQSPSSLSASVGDRVTITCRTSENVYSNL<br>AWYQQKPGKAPKLLIYAASNLQSGVPSRFSGSGSGTDYTFTISSL<br>QPEDIATYYCQHFWGSPFTFGCGTKLEIKGGSEGKSSGSGSESKS<br>TGGSQVQLVQSGAEVKKPGASVKVSCKASGYTFTNYDIIWVRQAP<br>GQCLEWMGYINPYNDGTKYNEKFKGRVTMTRDTSTSTVYMELSSL<br>RSEDTAVYYCARLLKYRRFRYYAIDYWGQGTTVTVSS | 122 |
| TPP-22212<br>Light Chain | DIQLTQSPSSLSASVGDRVTITCSASQDISNYLNWYQQKPGKAPK<br>VLIYFTSSLHSGVPSRFSGSGSGTDFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 123 |
| TPP-22212<br>Heavy Chain | EVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSDIQMTQSPSSLSASVGDRVTITCRTSENVYSNL<br>AWYQQKPGKAPKLLIYAASNLQSGVPSRFSGSGSGTDYTFTISSL<br>QPEDIATYYCQHFWGSPFTFGCGTKLEIKGGSEGKSSGSGSESKS<br>TGGSQVQLVQSGAEVKKPGASVKVSCKASGYTFTNYDIIWVRQAP<br>GQCLEWMGYINPYNDGTKYNEKFKGRVTMTRDTSTSTVYMELSSL<br>RSEDTAVYYCARLLKYRRFRYYAIDYWGQGTTVTVSS | 124 |
| TPP-22213<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 125 |
| TPP-22213<br>Heavy Chain | EVQLVESGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSDIQMTQSPSSLSASVGDRVTITCRTSENVYSNL<br>AWYQQKPGKAPKLLIYAASNLQSGVPSRFSGSGSGTDYTFTISSL<br>QPEDIATYYCQHFWGSPFTFGCGTKLEIKGGSEGKSSGSGSESKS<br>TGGSQVQLVQSGAEVKKPGASVKVSCKASGYTFTNYDIIWVRQAP<br>GQCLEWMGYINPYNDGTKYNEKFKGRVTMTRDTSTSTVYMELSSL<br>RSEDTAVYYCARLLKYRRFRYYAIDYWGQGTTVTVSS | 126 |

TABLE 1-continued

| Binding Molecule | Sequence | SEQ ID NO: |
|---|---|---|
| TPP-22214 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 127 |
| TPP-22214 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGCGTKLEIKGGSEGKSSGSGSESKS TGGSQVQLVQSGAEVKKPGASVKVSCKASGYTFTNYDIIWVRQAP GQCLEWMGYINPYNDGTKYNEKFKGRVTMTRDTSTSTVYMELSSL RSEDTAVYYCARLLKYRRFRYYAIDYWGQGTTVTVSS | 128 |
| TPP-22215 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 129 |
| TPP-22215 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGCGTKLEIKGGSEGKSSGSGSESKS TGGSQVQLVQSGAEVKKPGASVKVSCKASGYTFTNYDIIWVRQAP GQCLEWMGYINPYNDGTKYNEKFKGRVTMTRDTSTSTVYMELSSL RSEDTAVYYCARLLKYRRFRYYAIDYWGQGTTVTVSS | 130 |
| TPP-22216 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 131 |
| TPP-22216 Heavy Chain | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSDIQMTQSPSSLSASVGDRVTITCRTSENVYSNL AWYQQKPGKAPKLLIYAASNLQSGVPSRFSGSGSGTDYTFTISSL QPEDIATYYCQHFWGSPFTFGCGTKLEIKGGSEGKSSGSGSESKS TGGSQVQLVQSGAEVKKPGASVKVSCKASGYTFTNYDIIWVRQAP GQCLEWMGYINPYNDGTKYNEKFKGRVTMTRDTSTSTVYMELSSL RSEDTAVYYCARLLKYRRFRYYAIDYWGQGTTVTVSS | 132 |
| TPP-22217 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 133 |

TABLE 1-continued

| Binding Molecule | Sequence | SEQ ID NO: |
|---|---|---|
| TPP-22217 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGCGTKLEIKGGSEGK SSGSGSESKSTGGSQVQLVQSGAEVKKPGASVKVSCKASGYTFTN YDIIWVRQAPGQCLEWMGYINPYNDGTKYNEKFKGRVTMTRDTST STVYMELSSLRSEDTAVYYCARLLKYRRFRYYAIDYWGQGTTVTV SS | 134 |
| TPP-22218 Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 135 |
| TPP-22218 Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGCGTKLEIKGGSEGK SSGSGSESKSTGGSQVQLVQSGAEVKKPGASVKVSCKASGYTFTN YDIIWVRQAPGQCLEWMGYINPYNDGTKYNEKFKGRVTMTRDTST STVYMELSSLRSEDTAVYYCARLLKYRRFRYYAIDYWGQGTTVTV SS | 136 |
| TPP-22219 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 137 |
| TPP-22219 Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PGGGGGSGGGGSGGGGSGGGGSDIQMTQSPSSLSASVGDRVTITC RTSENVYSNLAWYQQKPGKAPKLLIYAASNLQSGVPSRFSGSGSG TDYTFTISSLQPEDIATYYCQHFWGSPFTFGCGTKLEIKGGSEGK SSGSGSESKSTGGSQVQLVQSGAEVKKPGASVKVSCKASGYTFTN YDIIWVRQAPGQCLEWMGYINPYNDGTKYNEKFKGRVTMTRDTST STVYMELSSLRSEDTAVYYCARLLKYRRFRYYAIDYWGQGTTVTV SS | 138 |
| TPP-22220 Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 139 |
| TPP-22220 Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS | 140 |

TABLE 1-continued

| Binding Molecule | Sequence | SEQ ID NO: |
|---|---|---|
| | CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGCGTKLEIKGGSEGK<br>SSGSGSESKSTGGSQVQLVQSGAEVKKPGASVKVSCKASGYTFTN<br>YDIIWVRQAPGQCLEWMGYINPYNDGTKYNEKFKGRVTMTRDTST<br>STVYMELSSLRSEDTAVYYCARLLKYRRFRYYAIDYWGQGTTVTV<br>SS | |
| TPP-22221<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 141 |
| TPP-22221<br>Heavy Chain | EVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGCGTKLEIKGGSEGK<br>SSGSGSESKSTGGSQVQLVQSGAEVKKPGASVKVSCKASGYTFTN<br>YDIIWVRQAPGQCLEWMGYINPYNDGTKYNEKFKGRVTMTRDTST<br>STVYMELSSLRSEDTAVYYCARLLKYRRFRYYAIDYWGQGTTVTV<br>SS | 142 |
| TPP-22222<br>Light Chain | DIQLTQSPSSLSASVGDRVTITCSASQDISNYLNWYQQKPGKAPK<br>VLIYFTSSLHSGVPSRFSGSGSGTGFTLTISSLQPEDFATYYCQQ<br>YSTVPWTFGQGTKVEIKRTVAAPSVFIFPPSDEQLKSGTASVVCL<br>LNNFYPREAKVQWKVDNALQSGNSQESVTEQDSKDSTYSLSSTLT<br>LSKADYEKHKVYACEVTHQGLSSPVTKSFNRGEC | 143 |
| TPP-22222<br>Heavy Chain | QVQLVQSGGGLVQPGGSLRLSCAASGYDFTHYGMNWVRQAPGKGL<br>EWVGWINTYTGEPTYAADFKRRFTFSLDTSKSTAYLQMNSLRAED<br>TAVYYCAKYPYYYGTSHWYFDVWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEAAGGPSVFLFPPKPKDTLMISRTPEVTCVVV<br>DVSHEDPEVKFNWYVDGVEVHNAKTKPREEQYNSTYRVVSVLTVL<br>HQDWLNGKEYKCKVSNKALPAPIEKTISKAKGQPREPQVYTLPPS<br>REEMTKNQVSLTCLVKGFYPSDIAVEWESNGQPENNYKTTPPVLD<br>SDGSFFLYSKLTVDKSRWQQGNVFSCSVMHEALHNHYTQKSLSLS<br>PGGGGGSGGGGSGGGGSGGGGSDIQMTQSPSSLSASVGDRVTITC<br>RTSENVYSNLAWYQQKPGKAPKLLIYAASNLQSGVPSRFSGSGSG<br>TDYTFTISSLQPEDIATYYCQHFWGSPFTFGCGTKLEIKGGSEGK<br>SSGSGSESKSTGGSQVQLVQSGAEVKKPGASVKVSCKASGYTFTN<br>YDIIWVRQAPGQCLEWMGYINPYNDGTKYNEKFKGRVTMTRDTST<br>STVYMELSSLRSEDTAVYYCARLLKYRRFRYYAIDYWGQGTTVTV<br>SS | 144 |
| VEGF binder<br>Ranibizumab<br>L-CDR1 | _S A S Q D I S N Y L N_ | 145 |
| VEGF binder<br>Ranibizumab<br>L-CDR2 | _F T S S L H S_ | 146 |
| VEGF binder<br>Ranibizumab<br>L-CDR3 | _Q Q Y S T V P W T_ | 147 |
| VEGF binder<br>Ranibizumab<br>H-CDR1 (CCG) | _G Y D F T H Y G M N_ | 148 |

TABLE 1-continued

| Binding Molecule | Sequence | SEQ ID NO: |
|---|---|---|
| VEGF binder Ranibizumab H-CDR2 (CCG) | W I N T Y T G E P T Y A A D F K R | 149 |
| VEGF binder Ranibizumab H-CDR3 (CCG) | Y P Y Y Y G T S H W Y F D V | 150 |
| VEGF binder Ranibizumab H-CDR1 (Kabat) | H Y G M N | 151 |
| VEGF binder Ranibizumab H-CDR2 (Kabat) | W I N T Y T G E P T Y A A D F K R | 152 |
| VEGF binder Ranibizumab H-CDR3 (Kabat) | Y P Y Y Y G T S H W Y F D V | 153 |
| VEGF binder Ranibizumab H-CDR1 (Chothia) | G Y D F T H Y | 154 |
| VEGF binder Ranibizumab H-CDR2 (Chothia) | N T Y T G E | 155 |
| VEGF binder Ranibizumab H-CDR3 (Chothia) | Y P Y Y Y G T S H W Y F D V | 156 |
| VEGF binder B20 L-CDR1 | R A S Q V I R R S L A | 157 |
| VEGF binder B20 L-CDR2 | A A S N L A S | 158 |
| VEGF binder B20 L-CDR3 | Q Q S N T S P L T | 159 |
| VEGF binder B20 H-CDR1 (CCG) | G F T I N A S W I H | 160 |
| VEGF binder B20 H-CDR2 (CCG) | A I Y P Y S G Y T N Y A D S V K G | 161 |
| VEGF binder B20 H-CDR3 (CCG) | W G H S T S P W A M D Y | 162 |
| VEGF binder B20 H-CDR1 (Kabat) | A S W I H | 163 |
| VEGF binder B20 H-CDR2 (Kabat) | A I Y P Y S G Y T N Y A D S V K G | 164 |
| VEGF binder B20 H-CDR3 (Kabat) | W G H S T S P W A M D Y | 165 |
| VEGF binder B20 H-CDR1 (Chothia) | G F T I N A S | 166 |
| VEGF binder B20 H-CDR2 (Chothia) | Y P Y S G Y | 167 |
| VEGF binder B20 H-CDR3 (Chothia) | W G H S T S P W A M D Y | 168 |
| VEGF binder G6 L-CDR1 | R A S Q D V S T A V A | 169 |
| VEGF binder G6 L-CDR2 | S A S F L Y S | 170 |
| VEGF binder G6 L-CDR3 | Q Q S Y T T P P T | 171 |

TABLE 1-continued

| Binding Molecule | Sequence | SEQ ID NO: |
|---|---|---|
| VEGF binder G6 H-CDR1 (CCG) | G F T I S D Y W I H | 172 |
| VEGF binder G6 H-CDR2 (CCG) | G I T P A G G Y T Y Y A D S V K G | 173 |
| VEGF binder G6 H-CDR3 (CCG) | F V F F L P Y A M D Y | 174 |
| VEGF binder G6 H-CDR1 (Kabat) | D Y W I H | 175 |
| VEGF binder G6 H-CDR2 (Kabat) | G I T P A G G Y T Y Y A D S V K G | 176 |
| VEGF binder G6 H-CDR3 (Kabat) | F V F F L P Y A M D Y | 177 |
| VEGF binder G6 H-CDR1 (Chothia) | G F T I S D Y | 178 |
| VEGF binder G6 H-CDR2 (Chothia) | T P A G G Y | 179 |
| VEGF binder G6 H-CDR3 (Chothia) | F V F F L P Y A M D Y | 180 |
| VEGF binder B20 Variable Light Chain (VL) | DIQMTQSPSSLSASVGDRVTITCRASQVIRRSLAWYQQKPGKAPK LLIYAASNLASGVPSRFSGSGSGTDFTLTISSLQPEDFATYYCQQ SNTSPLTFGQGTKVEIK | 181 |
| VEGF binder B20 Variable Heavy Chain (VH) | EVQLVESGGGLVQPGGSLRLSCAASGFTINASWIHWVRQAPGKGL EWVGAIYPYSGYTNYADSVKGRFTISADTSKNTAYLQMNSLRAED TAVYYCARWGHSTSPWAMDYWGQGTLVTVSS | 182 |
| VEGF binder G6 Variable Light Chain (VL) | DIQMTQSPSSLSASVGDRVTITCRASQDVSTAVAWYQQKPGKAPK LLIYSASFLYSGVPSRFSGSGSGTDFTLTISSLQPEDFATYYCQQ SYTTPPTFGQGTKVEIK | 183 |
| VEGF binder G6 Variable Heavy Chain (VH) | EVQLVESGGGLVQPGGSLRLSCAASGFTISDYWIHWVRQAPGKGL EWVAGITPAGGYTYYADSVKGRFTISADTSKNTAYLQMNSLRAED TAVYYCARFVFFLPYAMDYWGQGTLVTVSS | 184 |
| VEGF binder B20 Light Chain | DIQMTQSPSSLSASVGDRVTITCRASQVIRRSLAWYQQKPGKAPK LLIYAASNLASGVPSRFSGSGSGTDFTLTISSLQPEDFATYYCQQ SNTSPLTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 185 |
| VEGF binder B20 Heavy Chain | EVQLVESGGGLVQPGGSLRLSCAASGFTINASWIHWVRQAPGKGL EWVGAIYPYSGYTNYADSVKGRFTISADTSKNTAYLQMNSLRAED TAVYYCARWGHSTSPWAMDYWGQGTLVTVSSASTKGPSVFPLAPS SKSTSGGTAALGCLVKDYFPEPVTVSWNSGALTSGVHTFPAVLQS SGLYSLSSVVTVPSSSLGTQTYICNVNHKPSNTKVDKRVEPKSCD KTHTCPPCPAPEAAGGPSVFLFPPKPKDTLMISRTPEVTCVVVDV SHEDPEVKFNWYVDGVEVHNAKTKPREEQYNSTYRVVSVLTVLHQ DWLNGKEYKCKVSNKALPAPIEKTISKAKGQPREPQVYTLPPSRE EMTKNQVSLTCLVKGFYPSDIAVEWESNGQPENNYKTTPPVLDSD GSFFLYSKLTVDKSRWQQGNVFSCSVMHEALHNHYTQKSLSLSPG | 186 |
| VEGF binder G6 Light Chain | DIQMTQSPSSLSASVGDRVTITCRASQDVSTAVAWYQQKPGKAPK LLIYSASFLYSGVPSRFSGSGSGTDFTLTISSLQPEDFATYYCQQ SYTTPPTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 187 |
| VEGF binder G6 Heavy Chain | EVQLVESGGGLVQPGGSLRLSCAASGFTISDYWIHWVRQAPGKGL EWVAGITPAGGYTYYADSVKGRFTISADTSKNTAYLQMNSLRAED TAVYYCARFVFFLPYAMDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDK THTCPPCPAPEAAGGPSVFLFPPKPKDTLMISRTPEVTCVVVDVS HEDPEVKFNWYVDGVEVHNAKTKPREEQYNSTYRVVSVLTVLHQD WLNGKEYKCKVSNKALPAPIEKTISKAKGQPREPQVYTLPPSREE MTKNQVSLTCLVKGFYPSDIAVEWESNGQPENNYKTTPPVLDSDG SFFLYSKLTVDKSRWQQGNVFSCSVMHEALHNHYTQKSLSLSPG | 188 |

TABLE 1-continued

| Binding Molecule | Sequence | SEQ ID NO: |
|---|---|---|
| VEGF binder Ranibizumab Variable Light Chain (VL) | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIK | 189 |
| VEGF binder Ranibizumab Variable Heavy Chain (VH) | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSS | 190 |
| VEGF binder Ranibizumab (1Q) Variable Heavy Chain (VH) | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSS | 191 |
| VEGF binder Ranibizumab (6Q) Variable Heavy Chain (VH) | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSS | 192 |
| VEGF binder Ranibizumab (70G) Variable Light Chain (VL) | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIK | 193 |
| VEGF binder Ranibizumab (1Q/6Q) Variable Heavy Chain (VH) | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSS | 194 |
| VEGF binder Ranibizumab Light Chain | DIQLTQSPSSLSASVGDRVTITCSASQDISNYLNWYQQKPGKAPK VLIYFTSSLHSGVPSRFSGSGSGTDFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 195 |
| VEGF binder Ranibizumab Heavy Chain | EVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PG | 196 |
| VEGF binder Ranibizumab (1Q) Heavy Chain | QVQLVESGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PG | 197 |
| VEGF binder Ranibizumab (6Q) Heavy Chain | EVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PG | 198 |

TABLE 1-continued

| Binding Molecule | Sequence | SEQ ID NO: |
|---|---|---|
| VEGF binder Ranibizumab (70G) Light Chain | DIQLTQSPSSLSASVGDRVTITCSASQDISNYLNWYQQKPGKAPK VLIYFTSSLHSGVPSRFSGSGSGTGFTLTISSLQPEDFATYYCQQ YSTVPWTFGQGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC | 199 |
| VEGF binder Ranibizumab (1Q/6Q) Heavy Chain | QVQLVQSGGGLVQPGGSLRLSCAASGYDFTHYGMNWVRQAPGKGL EWVGWINTYTGEPTYAADFKRRFTFSLDTSKSTAYLQMNSLRAED TAVYYCAKYPYYYGTSHWYFDVWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEAAGGPSVFLFPPKPKDTLMISRTPEVTCVVV DVSHEDPEVKFNWYVDGVEVHNAKTKPREEQYNSTYRVVSVLTVL HQDWLNGKEYKCKVSNKALPAPIEKTISKAKGQPREPQVYTLPPS REEMTKNQVSLTCLVKGFYPSDIAVEWESNGQPENNYKTTPPVLD SDGSFFLYSKLTVDKSRWQQGNVFSCSVMHEALHNHYTQKSLSLS PG | 200 |
| TrkB binder C2 L-CDR1 | *R T S E N V Y S N L A* | 201 |
| TrkB binder C2 L-CDR2 | *A A S N L Q S* | 202 |
| TrkB binder C2 L-CDR3 | *Q H F W G S P F T* | 203 |
| TrkB binder C2 H-CDR1 (CCG) | G Y T F T N Y D I I | 204 |
| TrkB binder C2 H-CDR2 (CCG) | Y I N P Y N D G T K Y N E K F K G | 205 |
| TrkB binder C2 H-CDR3 (CCG) | L L K Y R R F R Y Y A I D Y | 206 |
| TrkB binder C2 H-CDR1 (Kabat) | N Y D I I | 207 |
| TrkB binder C2 H-CDR2 (Kabat) | Y I N P Y N D G T K Y N E K F K G | 208 |
| TrkB binder C2 H-CDR3 (Kabat) | L L K Y R R F R Y Y A I D Y | 209 |
| TrkB binder C2 H-CDR1 (Chothia) | *G Y T F T N Y* | 210 |
| TrkB binder C2 H-CDR2 (Chothia) | *N P Y N D G* | 211 |
| TrkB binder C2 H-CDR3 (Chothia) | *L L K Y R R F R Y Y A I D Y* | 212 |
| TrkB binder C2 (100C) Variable Light Chain (VL) | LLIYAASNLQSGVPSRFSGSGSGTDYTFTISSLQPEDIATYYCQH FWGSPFTFGCGTKLEIK | 213 |
| TrkB binder C2 (44C) Variable Heavy Chain (VH) | QVQLVQSGAEVKKPGASVKVSCKASGYTFTNYDIIWVRQAPGQCL EWMGYINPYNDGTKYNEKFKGRVTMTRDTSTSTVYMELSSLRSED TAVYYCARLLKYRRFRYYAIDYWGQGTTVTVSS | 214 |
| TrkB binder C2 Variable Light Chain (VL) | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPFTFGQGTKLEIK | 215 |
| TrkB binder C2 Variable Heavy Chain (VH) | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSS | 216 |
| 6GS | GGSGGS | 217 |
| 10L1 | GGGGSGGGGS | 218 |
| 15L1 | GGGGSGGGGSGGGGS | 219 |

TABLE 1-continued

| Binding Molecule | Sequence | SEQ ID NO: |
|---|---|---|
| 20L1 | GGGGSGGGGSGGGGSGGGGS | 220 |
| 20L3 | GGSEGKSSGSGSESKSTGGS | 221 |
| TrkB binder VL-VH (44C/100C) | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPPFTFGCGTKLEIKGGSEGKSSGSGSESKSTGGSQVQLVQSG AEVKKPGASVKVSCKASGYTFTNYDIIWVRQAPGQCLEWMGYINP YNDGTKYNEKFKGRVTMTRDTSTSTVYMELSSLRSEDTAVYYCAR LLKYRRFRYYAIDYWGQGTTVTVSS | 222 |
| TrkB binder VH-VL (44C/100C) | QVQLVQSGAEVKKPGASVKVSCKASGYTFTNYDIIWVRQAPGQCL EWMGYINPYNDGTKYNEKFKGRVTMTRDTSTSTVYMELSSLRSED TAVYYCARLLKYRRFRYYAIDYWGQGTTVTVSSGGSEGKSSGSGS ESKSTGGSDIQMTQSPSSLSASVGDRVTITCRTSENVYSNLAWYQ QKPGKAPKLLIYAASNLQSGVPSRFSGSGSGTDYTFTISSLQPED IATYYCQHFWGSPPFTFGCGTKLEIK | 223 |
| TrkB binder VL-VH | DIQMTQSPSSLSASVGDRVTITCRTSENVYSNLAWYQQKPGKAPK LLIYAASNLQSGVPSRFSGSGSGTDYTFTISSLQPEDIATYYCQH FWGSPPFTFGQGTKLEIKGGSEGKSSGSGSESKSTGGSQVQLVQSG AEVKKPGASVKVSCKASGYTFTNYDIIWVRQAPGQGLEWMGYINP YNDGTKYNEKFKGRVTMTRDTSTSTVYMELSSLRSEDTAVYYCAR LLKYRRFRYYAIDYWGQGTTVTVSS | 224 |
| TrkB binder VH-VL | QVQLVQSGAEVKKPGASVKVSCKASGYTFTNYDIIWVRQAPGQGL EWMGYINPYNDGTKYNEKFKGRVTMTRDTSTSTVYMELSSLRSED TAVYYCARLLKYRRFRYYAIDYWGQGTTVTVSSGGSEGKSSGSGS ESKSTGGSDIQMTQSPSSLSASVGDRVTITCRTSENVYSNLAWYQ QKPGKAPKLLIYAASNLQSGVPSRFSGSGSGTDYTFTISSLQPED IATYYCQHFWGSPPFTFGQGTKLEIK | 225 |
| 4GS | GGGS | 227 |

In a further embodiment the binding molecule of the invention or the TrkB binding molecule may be based on any of the below disclosed TrkB binders which are also disclosed in WO2018/224630.

TABLE 2

| TrkB binder 277 L-CDR1 | K S S Q S L L Y S S N Q K N Y L A | 228 |
|---|---|---|
| TrkB binder 277 L-CDR2 | W A S T R E S | 229 |
| TrkB binder 277 L-CDR3 | Q Q Y Y S Y P Y T | 230 |
| TrkB binder 277 H-CDR1 (CCG) | G Y T F T G Y W M H | 231 |
| TrkB binder 277 H-CDR2 (CCG) | Y I N P S T D Y T E Y N Q K F K D | 232 |
| TrkB binder 277 H-CDR3 (CCG) | S R T G N Y | 233 |
| TrkB binder 277 H-CDR1 (Kabat) | G Y W M H | 234 |
| TrkB binder 277 H-CDR2 (Kabat) | Y I N P S T D Y T E Y N Q K F K D | 235 |
| TrkB binder 277 H-CDR3 (Kabat) | S R T G N Y | 236 |

TABLE 2-continued

| | | |
|---|---|---|
| TrkB binder 277 H-CDR1 (Chothia) | G Y T F T G Y | 237 |
| TrkB binder 277 H-CDR2 (Chothia) | N P S T D Y | 238 |
| TrkB binder 277 H-CDR3 (Chothia) | S R T G N Y | 239 |
| TrkB binder 277-gr_VL, (humanized) variable light chain | DIVMTQSPDSLAVSLGERATINCKSSQSLLYSSNQKNYLAWYQQK PGQPPKLLIYWASTRESGVPDRFSGSGSGTDFTLTISSLQAEDVA VYYCQQYYSYPYTFGQGTKLEIK | 240 |
| TrkB binder 277-gr_VH, (humanized) variable heavy chain | QVQLVQSGAEVKKPGASVKVSCKASGYTFTGYWMHWVRQAPGQGL EWMGYINPSTDYTEYNQKFKDRVTMTRDTSTSTVYMELSSLRSED TAVYYCARSRTGNYWGQGTLVTVSS | 241 |
| TrkB binder 277-33_VL: (humanized) variable light chain | DIVMTQSPDSLAVSLGERATISCKSSQSLLYSSNQKNYLAWYQQK PGQPPKLLIYWASTRESGVPDRFSGSGSGTDFTLTISSLQAEDVA VYYCQQYYSYPYTFGGGTKLEIK | 242 |
| TrkB binder 277-33_VH, (humanized) variable heavy chain | QVQLVQSGAEVKKPGASVKVSCKASGYTFTGYWMHWVRQRPGQGL EWIGYINPSTDYTEYNQKFKDRVTLTRDTSTSTVYMELSSLTSED TAVYYCARSRTGNYWGQGTTVTVSS | 243 |
| TrkB binder 277-35_VL: (humanized) variable light chain | DIVMTQSPDSLAVSLGERATISCKSSQSLLYSSNQKNYLAWYQQK PGQPPKLLIYWASTRESGVPDRFSGSGSGTDFTLTISSLQAEDVA VYYCQQYYSYPYTFGGGTKLEIK | 244 |
| TrkB binder 277-35_VH, (humanized) variable heavy chain | QVQLVQSGAEVKKPGASVKVSCKASGYTFTGYWMHWVRQRPGQGL EWIGYINPSTDYTEYNQKFKDRVTLTRDTSTSTVYMELSSLRSED TAVYYCARSRTGNYWGQGTTVTVSS | 245 |
| TrkB binder 277-42_VL, (humanized) variable light chain | DIVMTQSPDSLAVSLGERATINCKSSQSLLYSSNQKNYLAWYQQK PGQPPKLLIYWASTRESGVPDRFSGSGSGTDFTLTISSLQAEDVA VYYCQQYYSYPYTFGGGTKLEIK | 246 |
| TrkB binder 277-42_VH, (humanized) variable heavy chain | QVQLVQSGAEVKKPGASVKVSCKASGYTFTGYWMHWVRQRPGQGL EWIGYINPSTDYTEYNQKFKDRVTLTRDTSTSTVYMELSSLRSED TAVYYCARSRTGNYWGQGTTVTVSS | 247 |
| TrkB binder 277-44_VL, (humanized) variable light chain | DIVMTQSPDSLAVSLGERATINCKSSQSLLYSSNQKNYLAWYQQK PGQSPKLLIYWASTRESGVPDRFSGSGSGTDFTLTISSLQAEDVA VYYCQQYYSYPYTFGQGTKLEIK | 248 |
| TrkB binder 277-44_VH, (humanized) variable heavy chain | QVQLVQSGAEVKKPGASVKVSCKASGYTFTGYWMHWVRQAPGQGL EWIGYINPSTDYTEYNQKFKDRVTMTRDTSTSTVYMELSSLTSED TAVYYCARSRTGNYWGQGTTVTVSS | 249 |
| TrkB binder 277-48_VL, (humanized) variable light chain | DIVMTQSPDSLAVSLGERATINCKSSQSLLYSSNQKNYLAWYQQK PGQPPKLLIYWASTRESGVPDRFSGSGSGTDFTLTISSLQAEDVA VYYCQQYYSYPYTFGQGTKLEIK | 250 |

TABLE 2-continued

| TrkB binder 277-48_VH, (humanized) variable heavy chain | QVQLVQSGAEVKKPGASVKVSCKASGYTFTGYWMHWVRQRPGQGL EWIGYINPSTDYTEYNQKFKDRVTMTRDTSTSTVYMELSSLRSED TAVYYCARSRTGNYWGQGTTVTVSS | 251 |
|---|---|---|
| TrkB binder 277-51_VL, (humanized) variable light chain | DIVMTQSPDSLAVSLGERATISCKSSQSLLYSSNQKNYLAWYQQK PGQPPKLLIYWASTRESGVPDRFSGSGSGTDFTLTISSLQAEDVA VYYCQQYYSYPYTFGGGTKLEIK | 252 |
| TrkB binder 277-51_VH, (humanized) variable heavy chain | QVQLVQSGAEVKKPGASVKVSCKASGYTFTGYWMHWVRQRPGQGL EWIGYINPSTDYTEYNQKFKDRATLTRDTSTSTVYMELSSLRSED TAVYYCARSRTGNYWGQGTTVTVSS | 253 |
| TrkB binder 277-64_VL, (humanized) variable light chain | DIVMTQSPDSLAVSLGERATISCKSSQSLLYSSNQKNYLAWYQQK PGQPPKLLIYWASTRESGVPDRFSGSGSGTDFTLTISSLQAEDVA VYYCQQYYSYPYTFGQGTKLEIK | 254 |
| TrkB binder 277-64_VH, (humanized) variable heavy chain | QVQLVQSGAEVKKPGASVKVSCKASGYTFTGYWMHWVRQAPGQGL EWIGYINPSTDYTEYNQKFKDRVTMTRDTSTSTVYMELSSLRSED TAVYYCARSRTGNYWGQGTTVTVSS | 255 |
| TrkB binder 277-67_VL, (humanized) variable light chain | DIVMTQSPDSLAVSLGERATINCKSSQSLLYSSNQKNYLAWYQQK PGQSPKLLIYWASTRESGVPDRFSGSGSGTDFTLTISSLQAEDVA VYYCQQYYSYPYTFGQGTKLEIK | 256 |
| TrkB binder 277-67_VH, (humanized) variable heavy chain | QVQLVQSGAEVKKPGASVKVSCKASGYTFTGYWMHWVRQAPGQGL EWIGYINPSTDYTEYNQKFKDRVTMTRDTSTSTVYMELSSLRSED TAVYYCARSRTGNYWGQGTTVTVSS | 257 |

In a preferred embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises light chain CDRs comprising or consisting of the amino acid sequences of SEQ ID NO:201 (CDR1), SEQ ID NO:202 (CDR2) and SEQ ID NO:203 (CDR3) and heavy chain CDRs comprising or consisting of the amino acid sequences of SEQ ID NO:204 (CDR1), SEQ ID NO:205 (CDR2) and SEQ ID NO:206 (CDR3); or heavy chain CDRs comprising or consisting of the amino acid sequences of SEQ ID NO:207 (CDR1), SEQ ID NO:208 (CDR2) and SEQ ID NO:209 (CDR3); or heavy chain CDRs comprising or consisting of the amino acid sequences of SEQ ID NO:210 (CDR1), SEQ ID NO:211 (CDR2) and SEQ ID NO:212 (CDR3); and wherein the antigen binding site that binds specifically to VEGF comprises light chain CDRs comprising or consisting of the amino acid sequences of SEQ ID NO:145 (CDR1), SEQ ID NO:146 (CDR2) and SEQ ID NO:147 (CDR3) and heavy chain CDRs comprising or consisting of the amino acid sequences of SEQ ID NO:148 (CDR1), SEQ ID NO:149 (CDR2) and SEQ ID NO:150 (CDR3); or heavy chain CDRs comprising or consisting of the amino acid sequences of SEQ ID NO:151 (CDR1), SEQ ID NO:152 (CDR2) and SEQ ID NO:153 (CDR3); or heavy chain CDRs comprising or consisting of the amino acid sequences of SEQ ID NO:154 (CDR1), SEQ ID NO:155 (CDR2) and SEQ ID NO:156 (CDR3).

In a further preferred embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises a light chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:213 or 215 and a heavy chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:214 or 216; and wherein the antigen binding site that binds specifically to VEGF comprises a light chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:189 or 193 and a heavy chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:190, 191, 192 or 194.

In a further preferred embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises a light chain variable domain comprising or consisting of an amino acid sequence of SEQ ID NO:213 or 215 and a heavy chain variable domain comprising or consisting of an amino acid sequence of SEQ ID NO:214 or 216; and wherein the antigen binding site that binds specifically to VEGF comprises a light chain variable domain comprising or consisting of an amino acid sequence of SEQ ID NO:189 or 193 and a heavy chain variable domain comprising or consisting of an amino acid sequence of SEQ ID NO:190, 191, 192 or 194.

In a further preferred embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises a light chain variable domain comprising or consisting of an amino acid sequence of SEQ ID NO:213 and a heavy chain variable domain comprising or consisting of an amino acid sequence of SEQ ID NO:214; and wherein the antigen binding site that binds specifically to VEGF comprises a light chain variable domain comprising or consisting of an amino acid sequence of SEQ ID NO:193 and a heavy chain variable domain comprising or consisting of an amino acid sequence of SEQ ID NO:191.

In a further preferred embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises a light chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:213 or 215 and a heavy chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:214 or 216, wherein the light chain CDRs in the light chain variable domain consist of the amino acid sequences of SEQ ID NO:201 (CDR1), SEQ ID NO:202 (CDR2) and SEQ ID NO:203 (CDR3) and the heavy chain CDRs in the heavy chain variable domain consist of the amino acid sequences of SEQ ID NO:204 (CDR1), SEQ ID NO:205 (CDR2) and SEQ ID NO:206 (CDR3); or the heavy chain CDRs in the heavy chain variable domain consist of the amino acid sequences of SEQ ID NO:207 (CDR1), SEQ ID NO:208 (CDR2) and SEQ ID NO:209 (CDR3); or the heavy chain in the heavy chain variable domain CDRs consist of the amino acid sequences of SEQ ID NO:210 (CDR1), SEQ ID NO:211 (CDR2) and SEQ ID NO:212 (CDR3); and wherein the antigen binding site that binds specifically to VEGF comprises a light chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:189 or 193 and a heavy chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:190, 191, 192 or 194, wherein the light chain CDRs in the light chain variable domain consist of the amino acid sequences of SEQ ID NO:145 (CDR1), SEQ ID NO:146 (CDR2) and SEQ ID NO:147 (CDR3) and the heavy chain CDRs in the heavy chain variable domain consist of the amino acid sequences of SEQ ID NO:148 (CDR1), SEQ ID NO:149 (CDR2) and SEQ ID NO:150 (CDR3); or the heavy chain CDRs in the heavy chain variable domain consist of the amino acid sequences of SEQ ID NO:151 (CDR1), SEQ ID NO:152 (CDR2) and SEQ ID NO:153 (CDR3); or the heavy chain CDRs in the heavy chain variable domain consist of the amino acid sequences of SEQ ID NO:154 (CDR1), SEQ ID NO:155 (CDR2) and SEQ ID NO:156 (CDR3).

In a further preferred embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises a light chain variable domain comprising or consisting of an amino acid sequence of SEQ ID NO:213 and a heavy chain variable domain comprising or consisting of an amino acid sequence of SEQ ID NO:214, wherein the light chain CDRs in the light chain variable domain consist of the amino acid sequences of SEQ ID NO:201 (CDR1), SEQ ID NO:202 (CDR2) and SEQ ID NO:203 (CDR3) and the heavy chain CDRs in the heavy chain variable domain consist of the amino acid sequences of SEQ ID NO:204 (CDR1), SEQ ID NO:205 (CDR2) and SEQ ID NO:206 (CDR3); or the heavy chain CDRs in the heavy chain variable domain consist of the amino acid sequences of SEQ ID NO:207 (CDR1), SEQ ID NO:208 (CDR2) and SEQ ID NO:209 (CDR3); or the heavy chain in the heavy chain variable domain CDRs consist of the amino acid sequences of SEQ ID NO:210 (CDR1), SEQ ID NO:211 (CDR2) and SEQ ID NO:212 (CDR3); and wherein the antigen binding site that binds specifically to VEGF comprises a light chain variable domain comprising or consisting of an amino acid sequence of SEQ ID NO:193 and a heavy chain variable domain comprising or consisting of an amino acid sequence of SEQ ID NO:191, wherein the light chain CDRs in the light chain variable domain consist of the amino acid sequences of SEQ ID NO:145 (CDR1), SEQ ID NO:146 (CDR2) and SEQ ID NO:147 (CDR3) and the heavy chain CDRs in the heavy chain variable domain consist of the amino acid sequences of SEQ ID NO:148 (CDR1), SEQ ID NO:149 (CDR2) and SEQ ID NO:150 (CDR3); or the heavy chain CDRs in the heavy chain variable domain consist of the amino acid sequences of SEQ ID NO:151 (CDR1), SEQ ID NO:152 (CDR2) and SEQ ID NO:153 (CDR3); or the heavy chain CDRs in the heavy chain variable domain consist of the amino acid sequences of SEQ ID NO:154 (CDR1), SEQ ID NO:155 (CDR2) and SEQ ID NO:156 (CDR3).

In one embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises light chain CDRs comprising or consisting of the amino acid sequences of SEQ ID NO:228 (CDR1), SEQ ID NO:229 (CDR2) and SEQ ID NO:230 (CDR3) and heavy chain CDRs comprising or consisting of the amino acid sequences of SEQ ID NO:231 (CDR1), SEQ ID NO:232 (CDR2) and SEQ ID NO:23 (CDR3); or heavy chain CDRs comprising or consisting of the amino acid sequences of SEQ ID NO:234 (CDR1), SEQ ID NO:235 (CDR2) and SEQ ID NO:236 (CDR3); or heavy chain CDRs comprising or consisting of the amino acid sequences of SEQ ID NO:237 (CDR1), SEQ ID NO:238 (CDR2) and SEQ ID NO:239 (CDR3); and wherein the antigen binding site that binds specifically to VEGF comprises light chain CDRs comprising or consisting of the amino acid sequences of SEQ ID NO:145 (CDR1), SEQ ID NO:146 (CDR2) and SEQ ID NO:147 (CDR3) and heavy chain CDRs comprising or consisting of the amino acid sequences of SEQ ID NO:148 (CDR1), SEQ ID NO:149 (CDR2) and SEQ ID NO:150 (CDR3); or heavy chain CDRs comprising or consisting of the amino acid sequences of SEQ ID NO:151 (CDR1), SEQ ID NO:152 (CDR2) and SEQ ID NO:153 (CDR3); or heavy chain CDRs comprising or consisting of the amino acid sequences of SEQ ID NO:154 (CDR1), SEQ ID NO:155 (CDR2) and SEQ ID NO:156 (CDR3).

In another embodiment, the binding molecule comprises at least one antigen binding site that binds specifically to Vascular Endothelial Growth Factor (VEGF) and at least one antigen binding site that binds specifically to Tropomyosin receptor kinase B (TrkB), wherein the antigen binding site that binds specifically to TrkB comprises a light chain variable domain and a heavy chain variable domain, each comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequences of SEQ ID NO:240 and 241, 242 and 243, 244 and 245, 246 and 247, 248 and 249, 250 and 251, 252 and 253, 254 and 255, or 256 and 257; and wherein the antigen binding site that binds specifically to VEGF comprises a light chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:189 or 193 and a heavy chain variable domain comprising or consisting of an amino acid sequence at least 80%, 81%, 82%, 83%, 84%, 85%, 86%, 87%, 88%, 89%, 90%, 91%, 92%, 93%, 94%, 95%, 96%, 97%, 98%, or at least 99% identical to the amino acid sequence of SEQ ID NO:190, 191, 192 or 194.

In a further preferred embodiment relating to any of the foregoing embodiments, the binding molecule is bispecific and tetravalent. For the avoidance of doubt, by binding of the binding molecules of the invention to their respective targets VEGF and TrkB, the binding molecules of the inventions act as VEGF antagonists or TrkB agonists, respectively.

In a further preferred embodiment relating to any of the foregoing embodiments, the antigen binding site that binds specifically to VEGF is an immunoglobulin (Ig) molecule and the at least one antigen binding site that binds specifically to TrkB comprises one or more scFv(s).

In a further preferred embodiment relating to any of the foregoing embodiments, the one or more scFv(s) is fused to the C-terminus of the heavy chain of the Ig molecule.

In a further preferred embodiment relating to any of the foregoing embodiments the at least one antigen binding site that binds specifically to VEGF is an immunoglobulin (Ig) molecule, more preferably an IgG, and the at least one antigen binding site that binds specifically to TrkB comprises one or more scFv(s), more preferably two scFv.

The antibody molecule or binding molecule described herein may be fused (as a fusion protein) or otherwise linked (by covalent or non-covalent bonds) to other molecular entities having a desired impact on the properties of the antibody molecule. For example, it may be desirable to improve pharmacokinetic properties of antibody or binding molecules described herein, stability e.g. in body fluids such as blood, in particular in the case of single chain antibodies or domain antibodies. A number of technologies have been developed in this regard, in particular to prolong the half-life of such antibody molecules in the circulation, such as pegylation (WO 98/25971; WO 98/48837; WO 2004081026), fusing or otherwise covalently attaching the antibody molecule to another antibody molecule having affinity to a serum protein like albumin (WO 2004041865; WO 2004003019), or expression of the antibody molecule as fusion protein with all or part of a serum protein like albumin or transferrin (WO 01/79258).

Since the Fc region of an antibody interacts with a number of Fc receptors, which results in a number of important functional capabilities (which are referred to as "effector functions"), the antibody is, in certain embodiments, a full length antibody or an antibody that contains a portion of the Fc region, the latter as long as the antibody exhibits specific binding both to the relevant portion of the antigen and to Fc receptors and complements. The choice of the type and length of the constant region depends on whether effector functions like complement fixation or antibody-dependent cell-mediated cytotoxicity are desirable features, and on the desired pharmacological properties of the antibody protein.

In an embodiment of the invention, stability of the scFv moiety can be increased by incorporation of two cysteine residues in close 3-dimensional proximity to form a disulfide bond within the scFv. To effect stabilization through engineered disulfide bonds, residues at these positions are preferably substituted with cysteine residues.

As demonstrated in the accompanying examples, the inventors have shown that a TrkB scFv having a VL-VH orientation from N- to C-terminus can function in the binding molecules of the invention to activate TrkB signalling. While a TrkB scFv having a VH-VL orientation from N- to C-terminus can also function, the activity may be reduced in this orientation. Hence a preferred embodiment of the invention is where the order is VL-VH from N- to C-terminus.

A further preferred embodiment of the invention is wherein the one or more scFv(s) specifically binding to TrkB is fused to the Ig molecule (e.g., human IgG1, IgG1(KO), IgG1FcRnmut, IgG4Pro) specifically binding to VEGF by a peptide linker, preferably a peptide linker having a length of about 4 to 20 amino acids (e.g., anyone of 6, 9, 10, 12, or 15). Preferably the scFv is fused to the C-terminus of the heavy chain of the Ig molecule. Preferably the Ig molecule is an IgG.

Methods of linking scFv molecules to the C-terminus of the heavy chain of the IgG molecule or linking the variable domains within scFv molecules are well known in the art. Typically a small linker sequence of glycine and serine (termed a GS mini-linker) amino acids is used. The number of amino acids in the linker can vary, from 4 (GGGS) (SEQ ID NO:227), 6 (GGSGGS) (SEQ ID NO:217), 10 (GGGGSGGGGS) (SEQ ID NO:218), 15 (GGGGSGGGGSGGGGS) (SEQ ID NO:219), 20 (GGGGSGGGGSGGGGSGGGGS) (SEQ ID NO:220) or more. In practice, normally the linker is formed by combining the nucleic acid molecule encoding the IgG of interest (which in the present case would include the nucleic acid encoding the variable domain of the heavy chain for the VEGF binding site and constant domains of the IgG type) with the nucleic acid encoding the desired scFv (which in the present case would include the nucleic acid encoding the variable domain of the heavy and light chain, either in VL-VH or VH-VL orientation for the TrkB binding site) interspaced by the nucleic acid molecule encoding the linker sequence (e.g. a GS mini linker of any one of 5, 10, 15, or 20 amino acids, preferably a linker of SEQ ID NO:218). Then as further explained below this complete HC-scFv encoding nucleic acid molecule is placed within an expression vector and introduced to appropriate host cells such that the complete IgG heavy chain-scFv single polypeptide is formed.

Preferably the GS mini-linker between the scFV molecule and the C-terminus of the heavy chain of the IgG molecule is 10L1 (SEQ ID NO:218).

In an embodiment of the invention, binding to complement product C1q or Fc gamma receptor by the binding molecule in this invention is ablated by utilization of the IgG4 constant region or of the IgG1 constant region with directed L to A mutagenesis at positions 234 and 235.

In an embodiment of the invention, the binding molecule of the invention may have an Fc region, or the relevant section thereof, that has been engineered to avoid unintended cross-linking by soluble Fc gamma receptors or complement C1 q. In one embodiment, such binding molecule or antibody variant has much lower affinities to Fcgamma receptors and complement C1q than the parent antibody. (In the following, if not otherwise stated, the term "parent" in the context of an antibody molecule, or in the context of IgG or the Fc region, refers to the non-engineered antibody molecule, Fc region or IgG, respectively, from which the mutated (engineered) molecule is derived.). Hence an embodiment of the invention is wherein the Ig molecule comprises a Fc variant having a reduced affinity to Fc gamma receptors or complement receptors or both compared to a wildtype Fc region. Such Ig molecule is referred to herein as IgG1(KO).

Also contemplated is a binding molecule comprising an Fc region, or the relevant section thereof, that has been engineered to modify serum levels (half-life) by optimizing its interaction with the neonatal Fc receptor (FcRn), e.g. by a point mutation in the CH2 domain at position H310A or a point mutation at position H435A). Such Ig molecule is referred to herein as IgG1 FcRnmut.

Further contemplated is a binding molecule comprising an Ig molecule which comprises a hinge region variant of IgG4 that ablates swapping of the heavy chains with other IgG4 molecules. Such Ig molecule is referred to herein as IgG4Pro.

A further aspect of the invention provides isolated nucleic acid molecules that encode the binding molecule of the invention or the antibody molecule of the invention, or an expression vector comprising such a nucleic acid molecule(s).

In some embodiments the binding molecules of the invention or antibody molecule of the invention comprise antibody heavy chain and/or light chain polypeptides. As can be appreciated by the skilled person, nucleic acid molecules can be readily prepared which encode the heavy chain polypeptides, light chain polypeptides, or heavy chain polypeptides and light chain polypeptides.

Nucleic acid molecules coding for the light chain and the heavy chain may be synthesized chemically and enzymatically by Polymerase Chain Reaction (PCR) using standard methods. First, suitable oligonucleotides can be synthesized with methods known in the art (e.g. Gait, 1984), which can be used to produce a synthetic gene. Methods to generate synthetic genes from oligonucleotides are known in the art (e.g. Stemmer et al., 1995; Ye et al., 1992; Hayden et Mandecki, 1988; Frank et al., 1987).

The nucleic acid molecules of the invention include, but are not limited to, the DNA molecules encoding the polypeptide sequences shown in the sequence listing. Also, the present invention also relates to nucleic acid molecules that hybridize to the DNA molecules encoding the polypeptide sequences shown in the sequence listing under high stringency binding and washing conditions, as defined in WO 2007/042309. Preferred molecules (from an mRNA perspective) are those that have at least 75% or 80% (preferably at least 85%, more preferably at least 90% and most preferably at least 95%) homology or sequence identity with one of the DNA molecules described herein. By way of example, in view of expressing the antibodies in eukaryotic cells, the DNA sequences shown in the sequence listing have been designed to match codon usage in eukaryotic cells. If it is desired to express the antibodies in $E.\ coli$, these sequences can be changed to match $E.\ coli$ codon usage. Variants of DNA molecules of the invention can be constructed in several different ways, as described e.g. in WO 2007/042309.

A further aspect of the invention provides a method of production of a binding or antibody molecule described herein, comprising:

(a) cultivating the host cell of the invention under conditions allowing expression of the molecule; and, (b) recovering the molecule; and optionally An embodiment of this aspect of the invention is wherein the method of production further comprises step (c) further purifying and/or modifying and/or formulating the binding molecule of the invention.

For producing the binding molecules or antibodies of the invention, the DNA molecules encoding full-length light and/or heavy chains or fragments thereof are inserted into an expression vector such that the sequences are operatively linked to transcriptional and translational control sequences.

For manufacturing the binding molecules or antibodies of the invention, the skilled artisan may choose from a great variety of expression systems well known in the art, e.g. those reviewed by Kipriyanov and Le Gall, Curr Opin Drug Discov Devel. 2004 March; 7(2):233-42.

Expression vectors include plasmids, retroviruses, cosmids, EBV-derived episomes, and the like. The expression vector and expression control sequences are selected to be compatible with the host cell. The antibody light chain gene and the antibody heavy chain gene or the gene of the heavy chain of the binding molecule described herein (e.g. the gene comprising an immunoglobulin heavy chain sequence attached with its C-terminus to a scFv sequence) can be inserted into separate vectors. In certain embodiments, both DNA sequences, light and heavy chain sequences, are inserted into the same expression vector. Convenient vectors are those that encode a functionally complete human CH or CL immunoglobulin sequence, with appropriate restriction sites engineered so that any VH or VL sequence can be easily inserted and expressed, as described above. The constant chain is usually kappa or lambda for the antibody light chain, for the antibody heavy chain, it can be, without limitation, any IgG isotype (IgG1, IgG2, IgG3, IgG4) or other immunoglobulins, including allelic variants.

The recombinant expression vector may also encode a signal peptide that facilitates secretion of the antibody chain (e.g., the heavy and light chains of the binding molecules or antibodies described herein) from a host cell. The DNA encoding the antibody chain may be cloned into the vector such that the signal peptide is linked in-frame to the amino terminus of the mature antibody chain DNA. The signal peptide may be an immunoglobulin signal peptide or a heterologous peptide from a non-immunoglobulin protein. Alternatively, the DNA sequence encoding the antibody chain (e.g., the heavy and light chains of the binding molecules or antibodies described herein) may already contain a signal peptide sequence.

In addition to the DNA sequences encoding the antibody chains (e.g., the heavy and light chains of the binding molecules or antibodies described herein), the recombinant expression vectors carry regulatory sequences including promoters, enhancers, termination and polyadenylation signals and other expression control elements that control the expression of the antibody chains in a host cell. Examples for promoter sequences (exemplified for expression in mammalian cells) are promoters and/or enhancers derived from (CMV) (such as the CMV Simian Virus 40 (SV40) (such as the SV40 promoter/enhancer), adenovirus, (e. g., the adenovirus major late promoter (AdMLP)), polyoma and strong mammalian promoters such as native immunoglobulin and actin promoters. Examples for polyadenylation signals are BGH polyA, SV40 late or early polyA; alternatively, 3'UTRs of immunoglobulin genes etc. can be used.

The recombinant expression vectors may also carry sequences that regulate replication of the vector in host cells (e. g. origins of replication) and selectable marker genes. Nucleic acid molecules encoding the heavy chain or an antigen-binding portion thereof and/or the light chain or an antigen-binding portion thereof of a binding molecule or antibody described herein, and vectors comprising these DNA molecules can be introduced into host cells, e.g. bacterial cells or higher eukaryotic cells, e.g. mammalian cells, according to transfection methods well known in the art, including liposome-mediated transfection, polycation-mediated transfection, protoplast fusion, microinjections, calcium phosphate precipitation, electroporation or transfer by viral vectors.

Preferably, the nucleic acid molecules encoding the heavy chain and the light chain of the binding molecules or antibodies described herein are present on two vectors which are co-transfected into the host cell, preferably a mammalian cell.

Hence a further aspect provides a host cell comprising an expression vector comprising a nucleic acid molecule encoding the heavy chain and an expression vector comprising a nucleic acid molecule encoding the light chain of the binding molecules or antibodies described herein.

Mammalian cell lines available as hosts for expression are well known in the art and include, inter alia, Chinese hamster ovary (CHO, CHO-DG44) cells, NSO, SP2/0 cells, HeLa cells, baby hamster kidney (BHK) cells, monkey kidney cells (COS), human carcinoma cells (e. g., Hep G2), A549 cells, 3T3 cells or the derivatives/progenies of any such cell line. Other mammalian cells, including but not limited to human, mice, rat, monkey and rodent cells lines, or other eukaryotic cells, including but not limited to yeast, insect and plant cells, or prokaryotic cells such as bacteria may be used. The binding molecules of the invention are produced by culturing the host cells for a period of time sufficient to allow for expression of the binding molecule in the host cells.

Binding molecules and antibody molecules as described herein are preferably recovered from the culture medium as a secreted polypeptide or it can be recovered from host cell lysates if for example expressed without a secretory signal. It is necessary to purify the binding molecules or antibody molecules described herein using standard protein purification methods used for recombinant proteins and host cell proteins in a way that substantially homogenous preparations of the binding molecule or antibody as described herein are obtained. By way of example, state-of-the art purification methods useful for obtaining the binding molecules and antibodies of the invention include, as a first step, removal of cells and/or particulate cell debris from the culture medium or lysate. The binding molecule or antibody is then purified from contaminant soluble proteins, polypeptides and nucleic acids, for example, by fractionation on immunoaffinity or ion-exchange columns, ethanol precipitation, reverse phase HPLC, Sephadex chromatography, chromatography on silica or on a cation exchange resin. As a final step in the process for obtaining a VEGF and TrkB single binding molecule as described herein, the purified binding molecule may be dried, e.g. lyophilized, as described below for therapeutic applications.

A further aspect of the invention provides the binding molecules of the invention for use in medicine. It will be understood that this use in medicine and the uses for treatment of diseases as described in the following also includes the TrkB binding molecules, scFv and antibodies according to the invention.

The binding molecules of the invention are indicated e.g. for use in the therapy/treatment of eye or retinal or neurodegenerative diseases, preferably for the treatment of neural/neuronal eye or retinal diseases. In a further aspect, the present invention relates to methods for the treatment and/or prevention of eye or retinal or neurodegenerative diseases, which method comprises the administration of an effective amount of the binding molecule of the invention to a human being (e.g. an individual suffering from wAMD or being at risk of developing geographic atrophy), thereby ameliorating one or more symptoms of the eye or retinal or neurodegenerative diseases.

The terms "treatment" and "therapy" and the like, as used herein, are meant to include therapeutic as well as prophylactic, or suppressive measures for a disease or disorder leading to any clinically desirable or beneficial effect, including but not limited to alleviation or relief of one or more symptoms, regression, slowing or cessation of progression of the disease or disorder. Thus, for example, the term treatment includes the administration of a binding molecule prior to or following the onset of a symptom of a disease or disorder thereby preventing or removing one or more signs of the disease or disorder. As another example, the term includes the administration of a binding molecule after clinical manifestation of the disease to combat the symptoms of the disease. Further, administration of a binding molecule after onset and after clinical symptoms have developed where administration affects clinical parameters of the disease or disorder, such as the degree of tissue injury or the amount or extent of metastasis, whether or not the treatment leads to amelioration of the disease, comprises "treatment" or "therapy" as used herein. Moreover, as long as the compositions of the invention either alone or in combination with another therapeutic agent alleviate or ameliorate at least one symptom of a disorder being treated as compared to that symptom in the absence of use of the binding molecule, the result should be considered an effective treatment of the underlying disorder regardless of whether all the symptoms of the disorder are alleviated or not.

A binding molecule of the invention can be administered to a subject having or at risk of having an eye or retinal disease. The invention further provides for the use of a binding molecule in the manufacture of a medicament for prevention and/or treatment of an eye or retinal disease. The term "subject" as used herein means any mammalian patient to which a binding molecule can be administered, including, e.g., humans and non-human mammals, such as primates, rodents, and dogs. Subjects specifically intended for treatment using the methods described herein include humans. The binding molecule can be administered either alone or in combination with other compositions.

In one embodiment, the binding molecules of the invention are used for the treatment of macular degeneration, age-related macular degeneration, diabetic retinopathy, diabetic macular edema, retinitis pigmentosa, inherited retinal dystrophy, inherited macular dystrophy, myopic degeneration, geographic atrophy, geographic atrophy secondary to age-related macular degeneration, retinal artery occlusions, endophthalmitis, uveitis, cystoid macular edema, choroidal neovascular membrane secondary to any retinal diseases, optic neuropathies, glaucoma, retinal detachment, toxic retinopathy, radiation retinopathy, and traumatic retinopathy, prodromal and mild-to-moderate alzheimer's diseases, delaying disease progression of patients with Alzheimer's disease, Huntington's disease, Parkinson's disease, major depressive disorder, schizophrenia, cognitive impairment associated with schizophrenia, prevention of first-episode psychosis in individuals with attenuated psychosis syndrome, prevention of relapse in patients with schizophrenia, treatment-resistant depression, hyperphagia, obesity or metabolic syndrome.

In a preferred embodiment, the binding molecules of the invention have utility in the treatment of wAMD. Further preferred, the binding molecules of the invention have utility in the treatment of wAMD and treatment of geographic atrophy. In a yet further preferred embodiment the binding molecules of the invention have utility in the treatment of geographic atrophy secondary to age-related macular degeneration. In a further preferred embodiment the binding molecules of the invention have utility in the treatment of geographic atrophy or the treatment of patients at risk for developing geographic atrophy. In a further preferred embodiment the binding molecules of the invention have utility in the prevention of geographic atrophy. In a most preferred embodiment the binding molecules of the invention have utility in the treatment of wAMD in patients at risk for developing geographic atrophy.

In another embodiment the binding molecules of the invention may be useful for treatment of hearing loss, in particular for cis platin induced hearing loss as well as noise and age-related hearing loss.

The binding molecule of the invention is administered by any suitable means, including intravitreal, oral, parenteral, subcutaneous, intraperitoneal, intrapulmonary, and intranasal. Parenteral infusions include intramuscular, intravenous, intraarterial, intraperitoneal, or subcutaneous administration. In addition, the binding molecule of the invention is suitably administered by pulse infusion, particularly with declining doses. In one aspect, the dosing is given by injections, most preferably intravenous or subcutaneous injections, depending in part on whether the administration is brief or chronic. Preferably, the binding molecule of the invention is given through an intravitreal injection into the eye.

In a further aspect, a binding molecule of the invention is used in combination with a device useful for the administration of the binding molecule, such as a syringe, injector pen, or other device. In a further aspect, a binding molecule of the invention is comprised in a kit of parts, for example also including a package insert with instructions for the use of the binding molecule.

The efficacy of the binding molecules of the invention, and of compositions comprising the same, can be tested using any suitable in vitro assay, cell-based assay, in vivo assay and/or animal model known per se, or any combination thereof, depending on the specific disease involved. Suitable assays and animal models will be clear to the skilled person, and for example include the assays and animal models used in the Examples below.

The actual pharmaceutically effective amount or therapeutic dosage will of course depend on factors known by those skilled in the art such as age and weight of the patient, route of administration and severity of disease. In any case the binding molecule of the invention will be administered at dosages and in a manner which allows a pharmaceutically effective amount to be delivered based upon patient's unique condition.

The binding molecules of the invention may be used on their own or in combination with other pharmacologically active ingredients, such as state-of-the-art or standard-of-care compounds.

Hence a further aspect of the invention provides a pharmaceutical composition comprising a binding molecule of the invention, together with a pharmaceutically acceptable carrier and optionally one or more further active ingredients.

For intravitreal injection of the binding molecules generally longer intervals between treatments are preferred. In one embodiment the binding molecule of the invention is administered every 6 weeks, preferably every 7 weeks, also preferred every 8 weeks, further preferred every 9 weeks, more preferred every 10 weeks, further preferred every 11 weeks, and more preferred every 12 weeks. In a further preferred embodiment the TrkB-antibody is administered once every 3 months. Depending on the specific binding molecule of the invention and its specific pharmacokinetic and other properties the frequency of administration may be even longer, such as every 13 weeks, 14 weeks, 15 weeks, 16 weeks, 17 weeks, 18 weeks, 19 weeks or 20 weeks.

Alternatively, other dosage regimens may be applied including e.g. a loading dose, wherein the binding molecules of the invention may be injected monthly for 3 loading doses and then every 12 weeks. Likewise, the frequency of administration may also be extended in such cases and may be even longer, such as every 13 weeks, 14 weeks, 15 weeks, 16 weeks, 17 weeks, 18 weeks, 19 weeks or 20 weeks.

The predicted estimated human dose of approximately 2.5 mg/eye corresponds to a 50 mg/mL formulation in which 50 μL will be injected into the eye.

To be used in therapy, the binding molecule of the invention is formulated into pharmaceutical compositions appropriate to facilitate administration to animals or humans. Typical formulations of the binding molecule or antibody molecule described herein can be prepared by mixing the binding with physiologically acceptable carriers, excipients or stabilizers, in the form of lyophilized or otherwise dried formulations or aqueous solutions or aqueous or non-aqueous suspensions. Carriers, excipients, modifiers or stabilizers are nontoxic at the dosages and concentrations employed. They include buffer systems such as phosphate, citrate, acetate and other inorganic or organic acids and their salts; antioxidants including ascorbic acid and methionine; preservatives such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol; proteins, such as serum albumin, gelatin, or immunoglobulins; hydrophilic polymers such as polyvinylpyrrolidone or polyethylene glycol (PEG); amino acids such as glycine, glutamine, asparagine, histidine, arginine, or lysine; monosaccharides, disaccharides, oligosaccharides or polysaccharides and other carbohydrates including glucose, mannose, sucrose, trehalose, dextrins or dextrans; chelating agents such as EDTA; sugar alcohols such as, mannitol or sorbitol; salt-forming counter-ions such as sodium; metal complexes (e.g., Zn-protein complexes); and/or ionic or non-ionic surfactants such as TWEEN™ (polysorbates), PLURONICS™ or fatty acid esters, fatty acid ethers or sugar esters. Also organic solvents can be contained in the formulation such as ethanol or isopropanol. The excipients may also have a release-modifying or absorption-modifying function.

Usually, aqueous solutions or suspensions will be preferred. Generally, suitable formulations for therapeutic proteins such as the binding molecules of the invention are buffered protein solutions, such as solutions including the protein in a suitable concentration (such as from 0.001 to 400 mg/ml, preferably from 0.005 to 200 mg/ml, more preferably 0.01 to 200 mg/ml, more preferably 1.0-100 mg/ml.

However, it will be clear to the person skilled in the art that the ingredients and the amounts thereof as given above do only represent one, preferred option. Alternatives and variations thereof will be immediately apparent to the skilled person, or can easily be conceived starting from the above disclosure.

TrkB Binding Molecule

Based on the surprising finding that the design of the TrkB binding sites (two scFv's) in the binding molecules of the invention apparently supports an optimal sterical formation of TrkB binding and activation—which may be independent of a further antigen binding site, such as a VEGF binding site or the VEGF induced clustering mechanism—the invention is further directed to a TrkB binding molecule comprising or consisting of two scFv's, wherein each scFv binds specifically to TrkB and both together act as a TrkB agonist.

Without wishing to be bound by theory the inventors believe that by combining two scFv's into a TrkB binding molecule, an optimal sterical formation of is achieved which results in the observed full TrkB agonist activity. Thus, in one aspect the TrkB binding molecules are full TrkB agonists, i.e. the TrkB binding molecules are as efficacious in activating TrkB as the natural ligand BDNF.

It is understood that the two scFv's in the TrkB binding molecule are connected to each other to form a TrkB binding molecule. The two scFv's in the Trkb binding molecule may be fused or otherwise covalently attached to each other. Alternatively, the two scFv's may be linked via a peptide linker, preferably a peptide linker e.g. having a length of about 4 to 20 amino acids and more preferably a flexible peptide linker.

Each scFv in the TrkB binding molecule may bind to the same or a different epitope within the TrkB protein. Preferably, both scFv bind to the same TrkB epitope.

The scFv's in the TrkB binding molecule may comprise from N to C terminus a VH domain (e.g. murine, humanized or human VH domain) a linker and a VL domain (e.g. murine, humanized or human VL domain), or vice versa a VL domain a linker and a VH domain). Preferably the scFv's in the TrkB binding molecule have a VL-VH orientation from N- to C-terminus.

In addition, the single chain Fv fragments might be further stabilized by incorporation of disulfide bonds between the VH and VL domains, within the VH domain, or within the VL domain, via incorporation of cysteine residues. The term N-terminus denotes the first amino acid of the polypeptide chain while the term C-terminus denotes the last amino acid of the C-terminus of the polypeptide chain. Hence in one embodiment the one or both scFv(s) comprise additional cysteine residues to form disulfide bonds.

In a further related aspect, the TrkB binding molecule may further comprise an Ig molecule. In this respect, the Ig molecule may be a monoclonal antibody, a human monoclonal antibody, a humanized monoclonal antibody, a chimeric antibody, a fragment of an antibody, such as a Fv, Fab, Fab', or F(ab')2 fragment, a single chain antibody, such as a single chain variable fragment (scFv), a Small Modular Immunopharmaceutical (SMIP), a domain antibody, a nanobody, or a diabody.

By adding a further Ig molecule optimal sterical formation of the two scFv's within the TrkB binding molecule for achievement of the full TrkB agonist effect is supported. This effect is believed to be independent of the specificity of the Ig molecule as the effect is based on the sterical formation of the TrkB binding molecule and not the specificity of the Ig molecule. Hence, the Ig molecule may be designed to bind to any target. Since, it is believed that the observed full agonist effect is mainly based on the sterical formation of the scFv's within the TrkB binding molecule, it follows that the Ig molecule may also not bind to any target specifically.

In a further preferred embodiment the Ig molecule comprises or consists of an Fc region. Preferably, in this embodiment each scFv is fused to the C-terminus of the heavy chain of the Fc region. In a further embodiment relating to this embodiment each scFv is fused to the Fc region by a peptide linker, preferably a peptide linker having a length of about 4 to 20 amino acids.

Also here, it is understood that the two scFv's and the Ig molecule in the TrkB binding molecule are connected to each other to form a TrkB binding molecule. The scFv's may be fused or otherwise covalently attached directly to the Ig molecule or they may be linked to the Ig molecule via a linker, preferably a peptide linker e.g. having a length of about 4 to 20 amino acids and more preferably a flexible peptide linker.

Preferably the scFv are fused to the C-terminus of the heavy chain of the Ig molecule. Preferably, the Ig molecule is an IgG, F(ab), or F(ab')2. Hence, in a preferred embodiment the TrkB binding molecule comprises or consists of two scFv's and an IgG, F(ab), or F(ab')$_2$ wherein each scFv binds specifically to TrkB. In a related preferred embodiment the TrkB binding molecule is bispecific and tetravalent and comprises or consists of two scFv's and an IgG or F(ab')$_2$ wherein each scFv binds specifically to TrkB. In a preferred embodiment the Ig molecule and more preferably the IgG, F(ab), or F(ab')$_2$ binds specifically to VEGF.

Methods of linking scFv molecules to the C-terminus of the heavy chain of the Ig molecule e.g. such as an IgG molecule or linking the variable domains within scFv molecules are well known in the art. Typically a small linker sequence of glycine and serine (termed a GS mini-linker) amino acids is used. The number of amino acids in the linker can vary, from 4 (GGGS) (SEQ ID NO:227), 6 (GGSGGS) (SEQ ID NO:217), 10 (GGGGSGGGGS) (SEQ ID NO:218), 15 (GGGGSGGGGSGGGGS) (SEQ ID NO:219), 20 (GGGGSGGGGSGGGGSGGGGS) (SEQ ID NO:220) or more. In practice, normally the linker is formed by combining the nucleic acid molecule encoding the Ig of interest with the nucleic acid encoding the desired scFv (which in the present case would include the nucleic acid encoding the variable domain of the heavy and light chain, either in VL-VH or VH-VL orientation for the TrkB binding site) interspaced by the nucleic acid molecule encoding the linker sequence (e.g. a GS mini linker of any one of 5, 10, 15, or 20 amino acids, preferably a linker of SEQ ID NO:218). Then as explained beforehand this complete HC-scFv encoding nucleic acid molecule is placed within an expression vector and introduced to appropriate host cells such that the complete Ig heavy chain-scFv single polypeptide is formed.

Preferably the GS mini-linker between the scFv molecule and the C-terminus of the heavy chain of the Ig molecule is 10L1 (SEQ ID NO:218).

In one aspect, a TrkB binding molecule is more potent in inducing activation of TrkB downstream signaling pathways than the natural TrkB ligand, BDNF. In a further aspect, a TrkB binding molecule regulates gene expression through TrkB-mediated signaling pathways in a comparable pattern to that of BDNF.

In a further aspect, a TrkB binding molecule is specific for TrkB phosphorylation and/or activation and does not unspecifically phosphorylate/activate TrkA or TrkC.

In one embodiment, the TrkB binding molecule comprises or consists of:
(i) two heavy chains, each comprising from N to C terminus:
(optionally) a heavy chain variable domain (e.g., murine, humanized or human VH domain)
constant domains, preferably of an IgG (e.g. human IgG1 or IgG4)
(optionally) a peptide linker (e.g. a GS mini linker) and an scFv specific for TrkB (e.g. an scFv comprising from N to C terminus a VH domain (e.g. murine, humanized or human VH domain) a linker and a VL domain (e.g. murine, humanized or human VL domain), or vice versa a VL domain a linker and a VH domain); and
(ii) two light chains, each comprising from N to C-terminus:
(optionally) a light chain variable domain (e.g. murine, humanized or human VL domain),
a light chain constant domain, preferably of an IgG (e.g., a human kappa chain).

The invention is now described by way of the following non-limiting examples.

Examples

Methods:
Cultivation of CHO Cells Expressing Trk Receptors

CHO cells expressing the human TrkB receptor (ThermoFisher Scientific, #K1491), and customised CHO cells expressing the human TrkA or TrkC receptor were cultured in DMEM (Lonza, #BE12-604F) supplemented with 10% fetal bovine serum, glutamax, non-essential amino acids, 20 mM HEPES, 5 µg/mL blasticidin and 200 µg/mL zeocin. Customized CHO cells expressing cyno, rabbit or rat TrkB receptor were cultured in a 1:1 mixture of Hams F12 (Lonza #BE12-615F) and DMEM (Lonza #BE12-604F) with 5% fetal bovine serum, 8 mM Glutamine, 0.5 mg/mL G418. Customised CHO cells expressing mouse TrkB receptor were cultured DMEM (Lonza #BE12-604F) supplemented with 10% fetal bovine serum, glutamax, 10 mM HEPES and 0.8 mg/mL G418.

Analysis of TrkA/B/C and ERK1/2 Phosphorylation in CHO Cells Expressing Human, Cyno, Rabbit, Rat, or mouseTrk Receptors Five thousand CHO cells expressing the respective Trk receptor were seeded in each cavity of a 384 well clear tissue culture plate (BD Falcon, #353963) and incubated in a humidified incubator at 37° C. and 5% $CO_2$. Twenty-four hours after seeding, the supernatant of the cells was replaced with room-temperature starvation medium (DMEM with 0.1% BSA (Sigma, #A-3059) but without other supplements). After 15 minutes, starvation medium with increasing concentrations of human BDNF (R&D #248-BD or Bachem #H-5594), human NGF (Biovision #4303R-20), human NT-3 (Sigma #N1905), agonistic antibodies, or isotype controls was added in triplicate for 45 minutes at room temperature to stimulate TrkB and ERK1/2 phosphorylation. Starvation medium alone served as control.

In some experiments, BDNF or the agonistic antibodies were pre-incubated for one hour without or with 2, 10, 50, or 200 ng/mL human VEGF (R&D Systems #293-VE-050), prior to stimulation of the cells. In these experiments, incubation with human VEGF alone served as control.

To analyze whether or not an agonistic TrkB antibody limits the BDNF-induced phosphorylation of TrkB and/or downstream ERK1/2 phosphorylation, CHO cells expressing the human TrkB receptor were incubated with growing concentrations of the antibody without or with a constant concentration of 0.3 nM, 1 nM or 3 nM BDNF.

After stimulation, cell supernatants were removed and cells were lysed for 20 minutes on wet ice in lysis buffer (1× Triton lysis buffer (Cell Signaling Technology #9803-S), supplemented with complete mini protease inhibitor tablets (Roche #04693124001) and phosphatase inhibitor cocktail 2 (Sigma #P5726) and 3 (Sigma #P0044), and 1 mM PMSF (Sigma #93482)). The resulting lysate was used for quantification of TrkA phosphorylation at Y680/681, TrkB phosphorylation at Y706/707, or TrkC phosphorylation at Y709/710 using a commercially available assay (Perkin Elmer #ALSU-PTRKAB-A10K), according to the manufacturer's instructions. Quantification of ERK1/2 phosphorylation at T202/Y204 (ERK1) and T185/Y187 (ERK2) was done similarly using another commercially available assay (Perkin Elmer #TGRES10K or ALSU-PERK-A10K), according to the manufacturer's instructions. Light emission of the acceptor beads, reflecting the phosphorylation events, was recorded at 570 nm on a Perking Elmer EnVision® microplate reader. Date were prepared for presentation with GraphPad Prism (version 8), including the raw data (mean±SEM) and a non-linear regression (log(agonist) vs. response (three parameters)).

Functional Characterization of the TkrB Extracellular Domain (TrkB-ECD)

CHO cells with stable expression of human TrkB were incubated with growing concentrations of the natural ligand BDNF or 10 nM BDNF with growing concentrations of TrkB-ECD (R&D Systems #1494-TB). TrkB activation was assessed by measuring TrkB phosphorylation on Y706/707 as outlined above. Data represent mean+/−SEM.

TrkB Receptor Internalization Assay

Twenty-four hours before stimulation, 25000 CHO cells expressing human TrkB receptor were seeded in each cavity of a 96 well black clear bottom tissue culture plate (PerkinElmer, #6055300) and incubated in a humidified incubator at 37° C. and 5% $CO_2$. The supernatant of the CHO/hTrkB cells was replaced with starvation medium (DMEM with 0.1% BSA (Sigma, #A-3059) and 20 mM Hepes (Lonza, #BE17-737F)) and the cells were incubate for 30 minutes at 37° C. Cells were then stimulated with increasing concentrations of BDNF (R&D #248-BD or Bachem #H-5594) or agonistic TrkB antibodies alone, or a combination of 1 nM BDNF with increasing concentrations of the agonistic antibodies in starvation medium for 50 minutes at 37° C. Cells were fixed for 20 minutes in 4% paraformaldehyde, washed, blocked in 5% normal donkey serum in PBS for one hour, and incubated over night at room temperature with 1 µg/mL goat anti-TrkB antibody (R&D Systems, #AF-397), followed by extensive washing and incubation in 2 µg/mL AlexaFluor® 647 donkey anti-goat antibody (ThermoFisher Scientific, #A21447) and 1 µg/mL Hoechst #H3570 for 2 hours at room temperature. After extensive washing, cells were stained for one hour with 2 pg/mL HCS-Cellmask™ green stain (ThermoFisher Scientific, #H32714) in PBS/ 0.05% Tween-20. Cell surface receptors were imaged on a PerkinElmer Opera Phenix High Content Screening System equipped with a 20× water objective and analyzed with PerkinElmer Harmony® High-Content Imaging and Analysis Software. Data are either presented as heatmap, with dark and light fields of the heatmap representing high and low percentage of cells above fluorescence threshold, respectively, or as diagram representing the percent of cells with surface TrkB staining intensity above threshold. In the latter case, data were prepared for presentation with GraphPad Prism (version 8), including the raw data (mean±SEM) and a non-linear regression (log(agonist) vs. response (three parameters))

Inhibition of VEGF-Induced VEGF Receptor 2 Phosphorylation and Downstream Signalling Human retinal microvascular endothelial cells (HRMEC; Cell Systems #ACBRI181) were cultured on gelatine— (Millipore #ES-006B) coated plates in endothelial cell basal medium (Promocell #C-22210) with supplements (Promocell #C-39210) and 10 U/mL penicillin/streptomycin, each. For analysis of VEGF-scavenging, 12000 cells were seeded in each cavity of a 96 well clear tissue culture plate using normal growth medium and incubated in a humidified incubator at 37° C. and 5% $CO_2$. Twenty-four hours later, the medium was replaced with starvation medium (Promocell #C-22210 supplemented with 0.1% BSA (Sigma, #A-3059) and 10 U/mL penicillin/streptomycin) and cells were starved for 20 hours in a humidified incubator at 37° C. and 5% $CO_2$. Before stimulation of VEGFR2 signalling, 50 ng/mL human VEGF (R&D Systems #293-VE-050) was pre-incubated without or with antagonistic antibodies or EYLEA® (aflibercept) for 30-60 minutes at room temperature in starvation medium and then pre-warmed to 37° C. for 15 minutes. Cell stimulation was accomplished for 5 minutes on a 37° C. warming plate by adding the pre-formed VEGF-antibody/EYLEA® (aflibercept) complexes or VEGF alone to the cells. Starvation medium alone served as control. Cells were lysed in lysis buffer (Perkin Elmer #ALSU-PVGFR-A500) for 10 minutes at room temperature and then incubated for additional 10 minutes on ice. According to the manufacturer's instructions, commercially available assays were used to quantify VEGFR2 phosphorylation at Y1175 (Perkin Elmer #ALSU-PVGFR-A500 or #ALSU-PVGFR-A10K), VEGFR2 phosphorylation at Y1214 (Perkin Elmer #ALSU-PVGFR-0500), VEGFR2 phosphorylation at Y951 (Perkin Elmer #ALSU-PVGFR-B500), ERK1/2 phosphorylation at T202/Y204 (ERK1) and T185/ Y187 (ERK2) (Perkin Elmer #TGRES10K or ALSU-PERK-A10K), Src phosphorylation at Y419 (Perkin Elmer #ALSU-PSRC-A10K), p38-MAPK phosphorylation at Thr180/ Tyr182 (Perkin Elmer #ALSU-PP38-B500). Light emission of the acceptor beads, reflecting above mentioned phosphorylation events, was recorded at 570 nm on a Perking Elmer EnVision® microplate reader and prepared for presentation with GraphPad Prism (version 8), including the raw data (mean±SEM) and a non-linear regression (log(agonist) vs. response (three parameters)).

To investigate the impact of TrkB-binding on VEGF-scavenging by the bispecific and tetravalent Doppelmabs, inhibition of VEGF-induced VEGFR2 phosphorylation was assessed in starved HRMEC in the absence or presence of the TrkB-ECD. Prior to stimulation, growing concentrations of the respective Doppelmab were incubated with 100 nM TrkB-ECD (R&D Systems #1494-TB) in starvation medium at room temperature for one hour, followed by incubation with 50 ng/mL human VEGF for another hour. As controls, HRMEC were incubated with (i) starvation medium alone, (ii) 50 ng/mL human VEGF, (iii) pre-formed complexes (one hour at room temperature) of 50 ng/mL human VEGF with growing concentrations of TrkB-ECD, (iv) pre-formed complexes (one hour at room temperature) of 50 ng/mL human VEGF with growing concentrations of the respective Doppelmab, and (v) growing concentrations of the TrkB-ECD alone. VEGF-A scavenging was assessed by measuring VEGF receptor 2 (VEGFR2) phosphorylation at Y1175 as outlined above.

Inhibition of VEGF-Induced HRMEC Proliferation

Three thousand HRMEC were seeded in each cavity of a clear flat bottom 96 well plate using endothelial cell basal medium (Promocell #C-22210) with supplements (Promocell #C-39210) and 10 U/mL penicillin/streptomycin, each, and incubated in a humidified incubator at 37° C. and 5% $CO_2$. Sixteen hours later, the growth medium was replaced by starvation medium (endothelial cell basal medium (Promocell #C-22210) supplemented with 2% fetal bovine serum) and cells were starved for eight hours in a humidified incubator at 37° C. and 5% $CO_2$. Before stimulation, human VEGF (R&D Systems #293-VE-050) was pre-incubated without or with antagonistic antibodies or EYLEA® (aflibercept) for 60 minutes at room temperature in starvation medium. Cell stimulation was done by adding the pre-formed VEGF-antibody/EYLEA® (aflibercept) complexes or VEGF alone to the cells. Starvation medium alone served as control (basal proliferation). Cell proliferation was assessed by automated, phase contrast image-based quantification of the total HRMEC nuclear areas (Essen Bioscience, IncuCyte S3), which was considered to be proportional to the HRMEC numbers. Four images per well were recorded with a 10× objective every four hours for a total period of 96 hours. Data represent relative cell numbers (cell number at time point t/cell number at t=0) as a function of time; cell numbers at t=0 were set to one. For some experiments, the area between each growth curve and the basal growth curve (proliferation in starvation medium) was plotted against the decadic logarithm of the respective compound concentration. Data were prepared for presentation with GraphPad Prism (version 8), including the raw data (mean±SEM) and a non-linear regression (log(agonist) vs. response (three parameters)) if applicable.

Inhibition of VEGF-Induced HRMEC Sprouting

Inhibition of VEGF-induced sprouting was assessed in a HRMEC-based spheroid assay. HRMEC were resuspended in normal growth medium containing 20% Methocel™ modified cellulose media (1.2% methylcellulose and 10% fetal bovine serum in endothelial basal medium) and 25 µl drops containing 500 HRMEC were applied on square petri dishes. The plates were turned upside down to cultivate the cells in hanging drops, which allows the spontaneous formation of spheroids. After 24 hours, the spheroids were harvested and embedded in a Methocel™ modified cellulose media—collagen mixture (80% Methocoel and 20% FCS 1:1 mixed with 3 mg/mL rat tail collagen I (Corning #354236) in M199 medium) in 48 well plates and incubated in a humidified incubator at 37° C. and 5% $CO_2$ for 30 minutes to accomplish collagen polymerization. Before stimulation, human VEGF (R&D Systems #293-VE-050) was pre-incubated without or with antagonistic antibodies or EYLEA® (aflibercept) for 60 minutes at room temperature in basal endothelial growth medium supplemented with 2% fetal bovine serum. Stimulation of sprouting was done by adding the pre-formed VEGF-antibody/EYLEA® (aflibercept) complexes or VEGF alone to the spheroids for 24 hours. Basal endothelial growth medium supplemented with 2% fetal bovine serum without VEGF served as control. After fixation in 4% paraformaldehyde, cells were extensively washed and stained over night with 2 µg/mL HCS-Cellmask™ green stain (ThermoFisher Scientific, #H32714) in PBS containing 0.2% Triton X-100. Spheroids were analyzed on a ZEISS LSM 780 confocal microscope. The three-dimensional sprouting of HRMEC was quantified from maximum projection images of Z-stacks either manually and expressed as accumulated sprout length per spheroid (mm), or semi-automated with the Zeiss ZEN-imaging software and expressed as spheroid perimeter (pixel). Data were prepared for presentation with GraphPad Prism (version 8) and represent mean±SEM.

Electroretinography

General Procedure

Electroretinography (ERG) is a non-invasive electrophysiological technique to assess light-induced electrical activity of different retinal neurons, and allows for quantifying different aspects of retinal function such as dim light or color vision. ERGs were measured as the potential change between a corneal and a reference electrode using the Espion E3 ERG recording system (Diagnosys LLC). Prior to ERG recordings, animals were dark adapted for at least 2 h, and anesthetized by i.p. injection of ketamine (Ketanest, ca. 100 mg/kg) and xylazin (Rompun, ca. 7 mg/kg). The animals were placed on a heated stage to maintain the body temperature constant at 37° C. Pupils were dilated with topical Tropicamid and 10% phenylephrine. A drop of Methocel™ 2% solution (OmniVision) was placed on the cornea to prevent corneas eyes from drying during recordings. Recordings were performed simultaneously from both eyes with gold loop electrodes. The reference electrode was a toothless alligator clip wetted with Methocel™ media and attached to the cheek of the animal. For electrical grounding, a clip was attached to the tail of the animal. ERG signals were sampled at 1 kHz and recorded with 0.15 Hz low-frequency and 500 Hz high-frequency cutoffs. The light stimuli consisted of full-field flashes (duration ~4 ms) delivered by a set of light-emitting diodes or a Xenon light bulb (for flashes 1 cd·s/m$^2$). All flashes were produced by a Ganzfeld stimulator (ColorDome; Diagnosys), either in darkness or on background light.

ERG Protocols

ERG responses were first recorded from dark-adapted animals (for isolating rod-driven responses), followed by recordings from animals adapted to red background light (50 cd/m$^2$, for isolating UV cone-driven ERG responses) and finally adapted to green-blue background light (25.5 cd/m$^2$, for isolating M cone-driven ERG responses).

In case of dark-adapted ERGs, responses were evoked by a series of flashes ranging from $1·10^{-5}$ to 100 cd·s/m$^2$. For flashes with the luminance of $1·10^{-5}$ and $3·10^{-5}$ cd·s/m$^2$, responses of 20 trials were averaged. For the flashes between $1·10^{-4}$ up to 0.05 cd·s/m$^2$, responses of 10 trials were averaged, for the flash of 0.1 cd·s/m$^2$, responses of 8 trials and for the flash of 1 cd·s/m$^2$, 5 trials were averaged. The last flashes of 10 cd·s/m$^2$, we recorded responses of 3 trials and for the final flash 100 cd·s/m$^2$, a single flash was recorded.

Intervals between individual flashes were chosen to ensure that the retina recovered completely from each flash (no indications of flash-induced reduction of response amplitudes or shortening of implicit times). Based on these criteria, the inter-flash intervals were 2 s for the $1·10^{-5}$ and $3·10^{-5}$ cd·s/m$^2$ flashes, 5 s for flashes between $1·10^{-4}$ up to 0.05 cd·s/m$^2$, 10 s for the flash of 0.1 cd·s/m$^2$, and 20 s for the flash of 1 cd·s/m$^2$. After the single flashes of 10 cd·s/m$^2$ and 100 cd·s/m$^2$, there was a recovery time of 30 s and 120 s, respectively.

For recordings of UV cone-driven and M cone-driven responses, animals were light-adapted for 2 min first to a red background light and afterwards to a green background light. Light responses were evoked by UV flashes of 0.02, 0.04, 0.08, 0.17, 0.35, 0.83, 1.66, 2.90, and 4.15 µW/m$^2$ and respectively by M cone flashes from 0.1 up to 110 cd·s/m$^2$ flashes. All responses of 10 trials were averaged with inter-flash intervals of 3 s.

Animals and STZ Treatment

Male Brown Norway rats (BN rats) were obtained from Charles River (Germany). Hyperglycemia was induced by i.p. injections of STZ (65 mg/kg body weight). Non- or poorly responding animals were not included into the study, i.e. animals with blood glucose concentrations <20 mM at day 7 post STZ application. Body weight and blood glucose levels were monitored regularly. STZ was administered ca. 3 weeks before intravitreal dosing.

Dosing and Intravitreal Injections

For ivt injections, rats were anesthetized with 2.5-3% isoflurane (Forene; Abbvie). A drop of 4 mg/ml oxybuprocainhydrochlorid (Novesine; Omnivision) was administered for topical local anesthesia. 5 µL were injected via a 34-gauge needle (fitted on a 10 µl Hamilton glass syringe) into the vitreous just behind the limbus in each eye.

Data Analysis

ERGs were measured as the potential change between a corneal and a reference electrode using the Espion E3 ERG recording system (Diagnosys LLC).

Before calculating with MATLAB™ software the different sets of each ERG flash were proved to be consistent before calculating a mean curve from each flash.

To determine ERG a-/b-wave amplitudes ERG data were processed and analyzed using the MATLAB™ software (version R2014a; MathWorks). In our case we sorted the data with an individual macro and prepared a file for our Matlab routines.

The b-wave amplitude was calculated from the bottom of the a-wave response to the peak of the b-wave peak. The b-wave implicit time was measured as the time after the flash stimulus needed to reach the peak of the b-wave.

The amplitudes of b-waves as a function of the stimulus intensity were fitted by using a least-square fitting procedure (GraphPad Prism, Version 6.01 and later on an upper Version of GraphPad Prism). The a-wave amplitude was calculated from baseline (zero line) to the negative a-wave response.

Statistical analysis was performed by one-way ANOVA.

Example 1

Overall Design of Binding Molecules Recognizing Human VEGF and Human TrkB

FIG. 1

The present inventors have developed binding molecules that bind VEGF and TrkB and act as VEGF antagonists and TrkB agonists respectively. The molecular design used has an IgG antibody (termed the "master antibody") which has specificity for one target antigen, with scFvs of a different specificity coupled to the C terminus of the heavy chain. A schematic of the design is shown in FIG. 1. Preferably the binding molecule is bispecific and tetravalent.

The bispecific molecule contains flexible peptide sequences between the variable heavy (VH) and variable light (VL) domains of the scFv, and the scFv domains are linked to the master IgG antibody via further series of linkers. In one configuration, the scFv is oriented such that the VL domain forms the "N-terminal" end of the scFv and is thus fused to the C-terminus of the heavy chain of the master antibody while the VH forms the C-terminus of the scFv and indeed the whole heavy chain polypeptide. However, it can be appreciated that this "N-VL-VH-C" structure can be reversed, i.e. "N-VH-VL-C".

To test feasibility of this concept, a number of different bispecific molecules based on the format depicted in FIG. 1 were prepared and further optimized over several cycles of molecule design starting from Series 1 through to Series 4.

The following Examples explain the methods used to generate the bispecific molecule of the different Series that binds VEGF and TrkB as well as variations in the format and the biological activity of these molecules.

Example 2

Preparation of Binding Domains that Recognize VEGF and TrkB

FIG. 1

As can be appreciated, to prepare bispecific molecules binding to human VEGF and TrkB, it is necessary to obtain variable domains that bind to their individual target antigens. For this purpose, Immunoglobulin (Ig) VH and VL genes were obtained from different VEGF and TrkB binders and formatted into the bispecific molecules of the invention. In total, three different VEGF binding domains were obtained from the individual VEGF binders termed B20, G6, and Ranibizumab. For binding to TrkB the binding domains were obtained from the individual TrkB binder termed C2 (WO2010086828).

Formatting of the individual binders into the bispecific molecules of the invention is performed by routine methods known to the skilled artisan. Briefly, to construct the gene segment encoding the scFv, pairs of VL and VH genes encoding the variable domains were joined by a gene segment encoding a flexible linker of peptide sequence GGSEGKSSGSGSESKSTGGS (SEQ ID NO:221). The resulting scFv-encoding gene segments were in turn cloned in-frame to the 3' end of a gene encoding the heavy chain of a human IgG antibody. These coding segments were synthesized by overlapping PCR methods and cloned into the expression vector pTT5.

The pairs of VL and VH genes encoding the Fab(2) part were then formatted into the bispecific format outlined in Example 1. The VH genes were cloned into pTT5 expression vector as an in-frame fusion at the 5' end of a gene encoding human Igγ. A gene encoding the scFv binder was cloned in frame at the 3' end of the same Igγ encoding segment. Similarly, the VL genes were cloned into pTT5 expression vector as an in-frame fusion with a gene encoding human IgG kappa light chain.

In-Fusion® HD Cloning Kit (Clonetech, U.S.A.) was used in the above procedure for directional cloning of VH and VL genes. PCR primers for VL/VH with 15 bp extensions complementary to the ends of the linearized vector were synthesized. PCR was performed using the manufacturer's standard protocol and the amplicons were purified or treated with Cloning Enhancer, then cloned into the appropriate vector. *E. coli* were then transformed according to manufacturer's instructions (Clonetech, U.S.A.). DNA minipreps were sequenced.

Each expression vector contains eukaryotic promoter elements for the chain-encoding gene, the gene encoding the signal sequence and the heavy or light chain, an expression cassette for a prokaryotic selection marker gene such as ampicillin, and an origin of replication. These DNA plasmids were propagated in ampicillin resistant *E. coli* colonies and purified.

The expression vectors were transfected into CHO-E cells. Transfected CHO-E cells growing in suspension in serum-free media were cultivated in shake flasks under agitation at 140 rpm, 37° C. and 5% $CO_2$ and kept at conditions of exponential growth. On the day of transfection, cells were chemically transfected with 1 mg of light chain plasmid and 0.5 mg of heavy chain plasmid. They were then seeded at 1 to $2\times10^6$ cells/ml in 1 L of Gibco® FreeStyle™ CHO expression medium (LifeTechnologies, NY, US). Cells were then incubated under orbital shaking for 10 to 12 days with one-time feeding of 150 ml commercial feed solution to allow expression of the proteins. Binding molecule titers in the cell culture supernatants were determined using an Octet® instrument (Pall ForteBio, CA, US) and protA biosensor tips according to manufacturer's instructions.

Recombinant binding molecules were purified from culture supernatant by Protein A affinity chromatography using MabSelect™ SuRe™ (Cytiva) followed by either size exclusion chromatography (Superdex® 200 column, Cytiva) or cation exchange chromatography (POROS™ 50 HS, ThermoFisher) and stored in 60 mM NaOAc buffer, 100 mM NaCl (pH 5.0). Purity and degree of heterogeneity of the samples were assessed by mass spectrometry and analytical size exclusion chromatography. All samples were confirmed to have a monomer content of ≥90% and contain <10% impurities prior to functional testing.

This resulted in the generation of the bispecific, tetravalent binding molecules through the different Series 1 to Series 4 as shown below in Table 3 and in the following are also referred to as Doppelmabs (DMabs) (cf. also Vekataramani et al., *Biochemical and Biophysical Research Communications*, Volume 504, Issue 1, 26 Sep. 2018, Pages 19-24).

TABLE 3

| | Fab | ScFv/Orientation | Linker | Series | Modifications |
|---|---|---|---|---|---|
| TPP-11735 | C2 | B20 VH-VL | 20L3 | 1 | |
| TPP-11736 | C2 | B20 VL-VH | 20L3 | 1 | |
| TPP-11737 | C2 | G6 VH-VL | 20L3 | 1 | |
| TPP-11738 | C2 | G6 VL-VH | 20L3 | 1 | |
| TPP-14936 | C2 | Ranibizumab VH-VL | 20L3 | 1 | |
| TPP-14937 | C2 | Ranibizumab VL-VH | 20L3 | 1 | |
| TPP-16061 | C2 | B20 VL-VH | 20L1 | 1 | |
| TPP-16062 | C2 | B20 VL-VH | 15L1 | 1 | |
| TPP-16063 | C2 | B20 VL-VH | 10L1 | 1 | |
| TPP-16064 | C2 | B20 VL-VH | 6GS | 1 | |
| TPP-19984 | C2 | Ranibizumab VH-VL | 10L1 | 1 | |
| TPP-19985 | C2 | Ranibizumab VH-VL | 20L1 | 1 | |
| TPP-14938 | B20 | C2 VH-VL | 20L3 | 2 | |
| TPP-14939 | B20 | C2 VL-VH | 20L3 | 2 | |
| TPP-14940 | Ranibizumab | C2 VH-VL | 20L3 | 2 | |
| TPP-14941 | Ranibizumab | C2 VL-VH | 20L3 | 2 | |
| TPP-19986 | Ranibizumab | C2 VH-VL | 10L1 | 3 | |
| TPP-19987 | Ranibizumab | C2 VH-VL | 20L1 | 3 | |
| TPP-19988 | Ranibizumab | C2 VL-VH | 10L1 | 3 | |
| TPP-19989 | Ranibizumab | C2 VL-VH | 20L1 | 3 | |
| TPP-22171 | Ranibizumab | C2 VH-VL | 10L1 | 4 | CC |
| TPP-22173 | Ranibizumab | C2 VL-VH | 10L1 | 4 | CC |
| TPP-22180 | Ranibizumab | C2 VH-VL | 10L1 | 4 | 1Q6Q70G |
| TPP-22187 | Ranibizumab | C2 VL-VH | 10L1 | 4 | 1Q |
| TPP-22188 | Ranibizumab | C2 VL-VH | 10L1 | 4 | 6Q |
| TPP-22189 | Ranibizumab | C2 VL-VH | 10L1 | 4 | 70G |
| TPP-22190 | Ranibizumab | C2 VL-VH | 10L1 | 4 | 1Q70G |
| TPP-22191 | Ranibizumab | C2 VL-VH | 10L1 | 4 | 6Q70G |
| TPP-22192 | Ranibizumab | C2 VL-VH | 10L1 | 4 | 1Q6Q70G |
| TPP-22204 | Ranibizumab | C2 VH-VL | 10L1 | 4 | CC1Q6Q70G |
| TPP-22211 | Ranibizumab | C2 VL-VH | 10L1 | 4 | CC1Q |
| TPP-22212 | Ranibizumab | C2 VL-VH | 10L1 | 4 | CC6Q |
| TPP-22213 | Ranibizumab | C2 VL-VH | 10L1 | 4 | CC70G |
| TPP-22214 | Ranibizumab | C2 VL-VH | 10L1 | 4 | CC1Q70G |
| TPP-22215 | Ranibizumab | C2 VL-VH | 10L1 | 4 | CC6Q70G |
| TPP-22216 | Ranibizumab | C2 VL-VH | 10L1 | 4 | CC1Q6Q70G |
| TPP-23457 | Ranibizumab | TPP-6830 VH-VL | 10L1 | 4 | |
| TPP-23459 | Ranibizumab | TPP-6830 VL-VH | 10L1 | 4 | |

Briefly, the following design activities were performed:

Series 1

In Series 1 binding molecules were generated having an antigen-binding fragment (Fab) as TrkB binding part in the bispecific binding molecule. The VEGF binding part was formatted as scFv(2) and different VEGF binders were evaluated, e.g. B20, G6 or Ranibizumab. Furthermore, different VL-VH or VH-VL orientation were tested and several linkers, such as 20L3, 20L1, 15L1, 10L1, 6GS were used in the design of the binding molecules.

Series 2

In Series 2 binding molecules were generated having an antigen-binding fragment (Fab) as VEGF binding part in the bispecific binding molecule and again different VEGF binders were evaluated. This time the TrkB binding part was formatted as scFv(2) and different VL-VH or VH-VL orientation were tested.

Series 3

In Series 3 binding molecules were generated based on Ranibizumab as antigen-binding fragment (Fab) and VEGF binding part in the bispecific binding molecule. The TrkB binding part was again formatted as scFv(2) and based on the C2 TrkB binder. Permutations in VL-VH or VH-VL orientation and different linkers were tested.

Series 4

In the final Series 4, different mutations were introduced into the Ranibizumab binding part, such as VHE1Q, VHE6Q, and/or VLD70G and the stabilizing effect of CC bridge was analyzed in the TrkB binding scFv parts.

The results of these design activities and their impact on the properties and biological activity are now described in more detail in the following examples.

Example 3

Comparison of Human TrkB Activation by C2, BDNF and the Four Doppelmabs TPP-11735, 736, 737 and 738 of the First Series

FIG. 2 A-B

CHO cells with stable expression of human TrkB were incubated with growing concentrations of the natural TrkB ligand BDNF, the C2 antibody, an IgG1 isotype control or the four Doppelmabs TPP-11735, TPP-11736, TPP-11737, TPP-11738. TrkB activation was assessed by measuring (A) TrkB phosphorylation on Y706/707 or (B) ERK1/2 phosphorylation on T202/Y204 (ERK1) and T185/Y187 (ERK2), respectively, downstream of TrkB. The lowest compound concentration is solvent alone.

Results:

TrkB activation by DMabs was virtually identical to the parental C2 molecule. Also, the DMabs showed the same properties as the parental C2 molecule and acted as partial TrkB agonists having an efficacy of TrkB activation at around ~40-50% of BDNF (pTrkB). Although, the DMab did incorporate the entire (Fab)$_2$ portion of the parental C2 antibody without changing the sequence or the orientation/layout this was a very encouraging result, as it showed that formatting into this specific format did not negatively affect the ability of the TrkB binder to activate TrkB and TrkB downstream signalling. As expected the isotype control did not activate TrkB.

Example 4

Comparison of Cyno/Rabbit/Rat/Mouse TrkB Activation by C2, BDNF and the Doppelmabs TPP-11735/736 of the First Series

FIG. 3A-D

CHO cells with stable expression of (A) cyno TrkB, (B) rabbit TrkB, (C) rat TrkB or (D) mouse TrkB were incubated with growing concentrations of the natural TrkB ligand BDNF, the C2 antibody, or the Doppelmabs TPP-11735 or TPP-11736. TrkB activation was assessed by measuring TrkB phosphorylation on Y706/707. The lowest compound concentration is solvent alone. Data represent mean+/−SEM.

Results:

Again, TrkB activation by DMabs was virtually identical to the parental C2 molecule and activation was comparable to activation of human TrkB receptor. Also in this assay the DMabs showed the same properties as the parental C2 molecule and acted as partial TrkB agonists having an efficacy of TrkB activation at around ~40-50% of BDNF (pTrkB).

Example 5

Selectivity of TPP-11735/736/737/738 Mediated TrkB Activation

FIG. 4 A-C

CHO cells with stable expression of (A) human TrkA, (B) human TrkB, or (C) human TrkC were incubated with growing concentrations of the C2 antibody or the four Doppelmabs TPP-11735, TPP-11736, TPP-11737, TPP-11738. Activation of the Trk receptors was assessed by measuring receptor phosphorylation on Y706/707. Incubation with growing concentrations of the natural ligands for TrkA (NGF), TrkB (BDNF) and TrkC (NT-3) were used as controls. The lowest compound concentration is solvent alone. Data represent the mean+/−SEM.

Results:

None of the tested Doppelmabs activated either TrkA or TrkC. All Doppelmabs were very specific/selective for TrkB.

Example 6

Comparison of C2-, TPP-11736- and/or BDNF-Induced Internalization of Human TrkB Receptor

FIG. 5 A-B (A) CHO cells with stable expression of human TrkB were incubated with growing concentrations of the natural TrkB ligand BDNF, or 1 nM BDNF with growing concentrations of the C2 antibody or the Doppelmab TPP-11736. (B) TrkB internalization was assessed by immunofluorescence staining of surface TrkB receptors without permeabilization of the cells, followed by confocal microscopy analysis. Dark and light fields of the heatmap represent high and low percentage of cells above fluorescence threshold, respectively.

Results:

BDNF induced TrkB receptor internalization (lanes 1+2; heatmap fields are getting darker from top to bottom).

The antibody C2 and TPP-11736 decreased the BDNF-induced internalization of the TrkB receptor (lanes 3-5 and 6-8; note that heatmap fields are getting darker from bottom to top).

Example 7

Comparison of Human TrkB Activation by C2 and TPP-11736 (First Series) in the Presence or Absence of Human VEGF

FIG. 6

CHO cells with stable expression of human TrkB were incubated with growing concentrations of the C2 tool antibody or the Doppelmab TPP-11736, without or with pre-incubation with 200 ng/mL human VEGF-A (hVEGF). TrkB activation was assessed by measuring ERK1/2 phosphorylation on T202/Y204 (ERK1) and T185/Y187 (ERK2), downstream of TrkB. Incubation with growing concentrations of human VEGF-A without antibody served as control. The lowest compound concentration is solvent alone. Data represent the mean. For clarity, error bars are omitted.

Results:

Incubation with human VEGF alone did not change ERK1/2 phosphorylation.

Also, pre-incubation with human VEGF did neither change the potency nor the efficacy of ERK1/2 phosphorylation by C2 or TPP-11736 substantially.

Example 8

Neuroprotective Efficacy of DMab 11736 and C2 in STZ-Induced Diabetic Rats

FIG. 7

Figure 7:
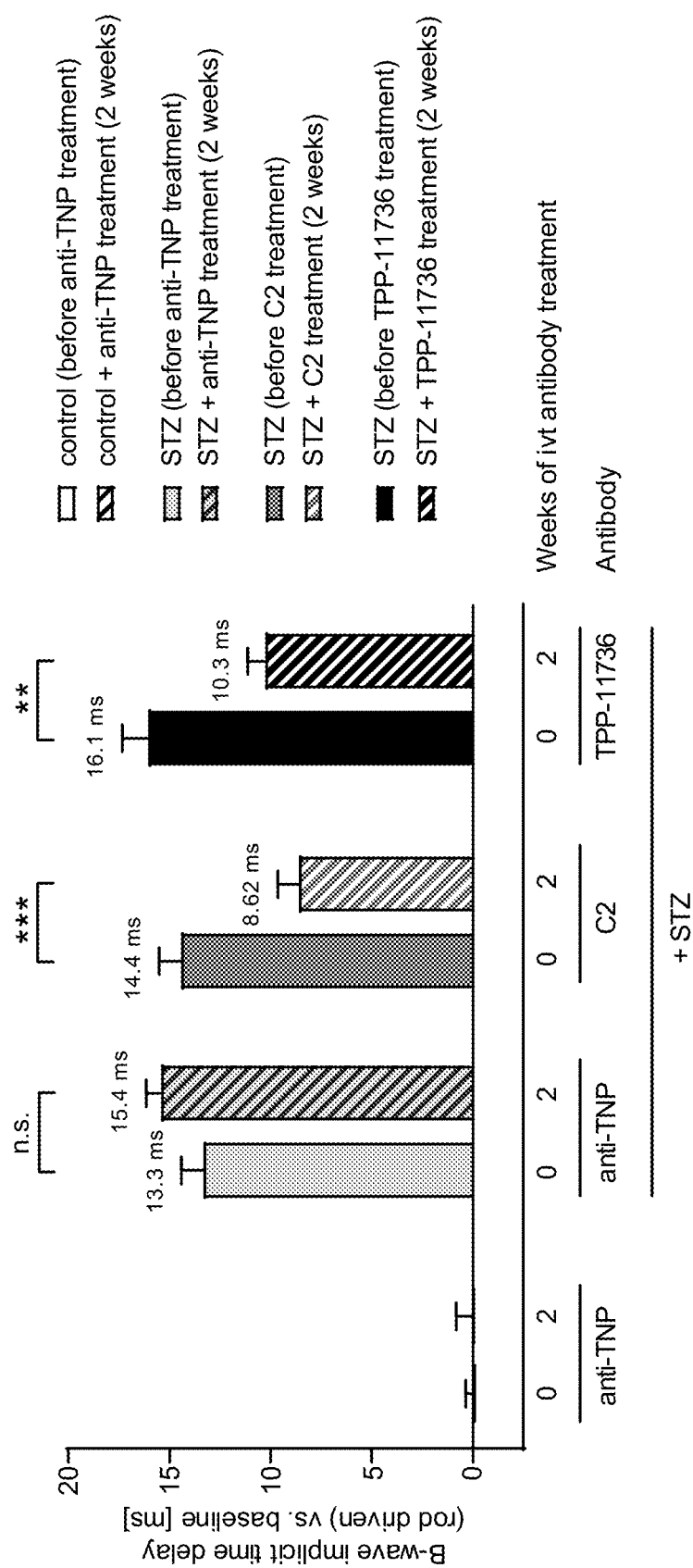
FIG. 7: Neuroprotective function of TrkB activation in a rat model of diabetes-induced retinal neurodegeneration. Animals were treated with STZ to induce hyperglycemia. The retinal function was then assessed by electroretinography (ERG) and rod-driven B-wave implicit time delays immediately before and two weeks after intravitreal application of the agonistic TrkB antibody C2 or Doppelmab TPP-11736; mean+/−SEM; $^{n.s.}$p>0.05, non-significant; p<0.01; *p<0.001; one-way Anova with Tukey multi-comparison test. Anti-TNP served as isotype control antibody.
Figure 8:
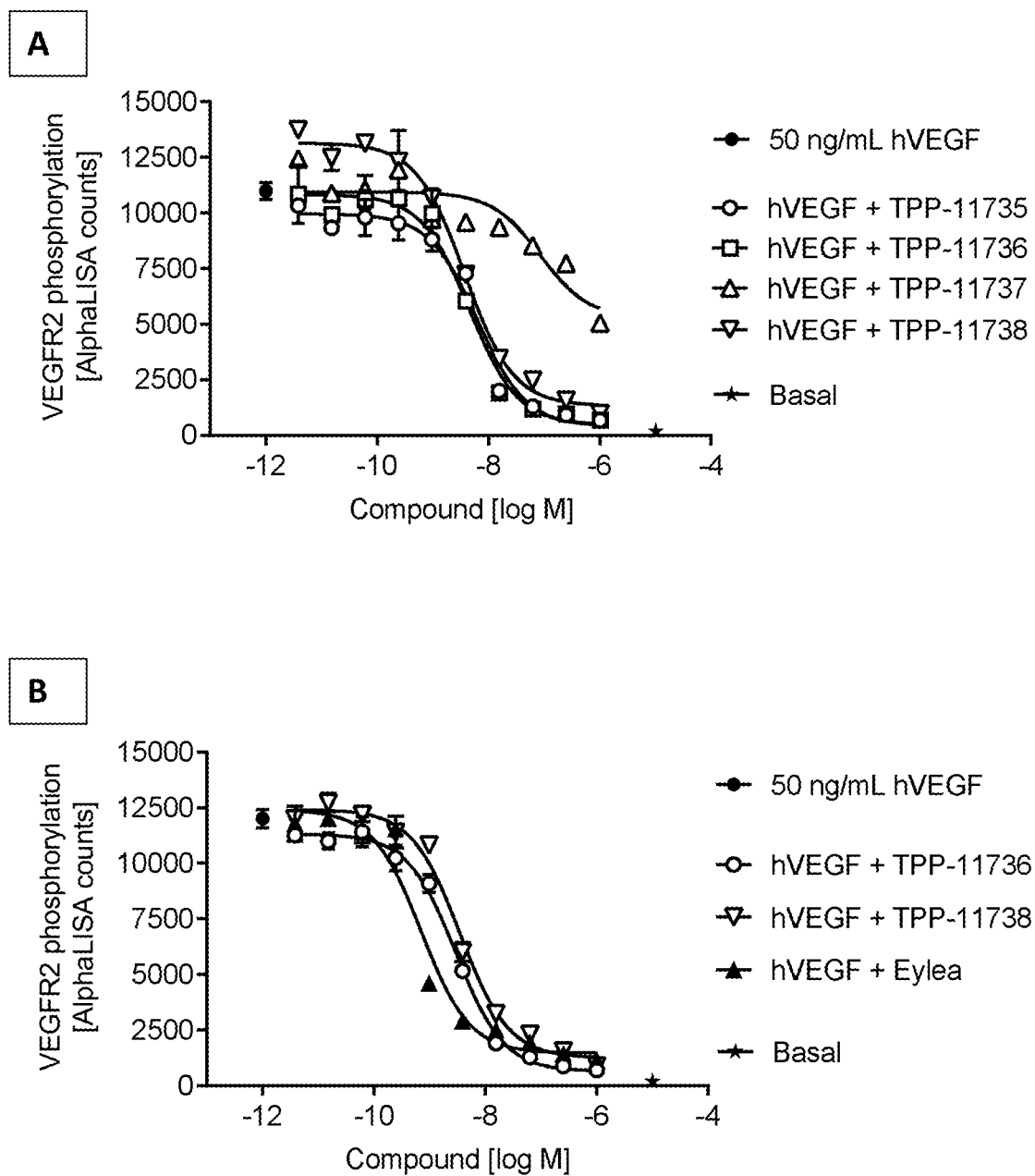
FIG. 8 A-B: VEGF-A scavenging was assessed by measuring VEGF receptor 2 phosphorylation (Y1175—VEGFR2). For this purpose, human retinal microvascular endothelial cells (HRMECs) were starved and then incubated with 50 ng/mL human VEGF with or without pre-incubation with growing concentrations of the indicated molecules. (A) Comparison of Doppelmabs TPP-11735, -736, -737 and -738. (B) Comparison of TPP-11736 and TPP-11738 with EYLEA® (aflibercept). Non-stimulated cells (Basal) and 50 ng/ml human VEGF without antibody treatment served as control. Data represent mean+/−SEM.
Figure 9:
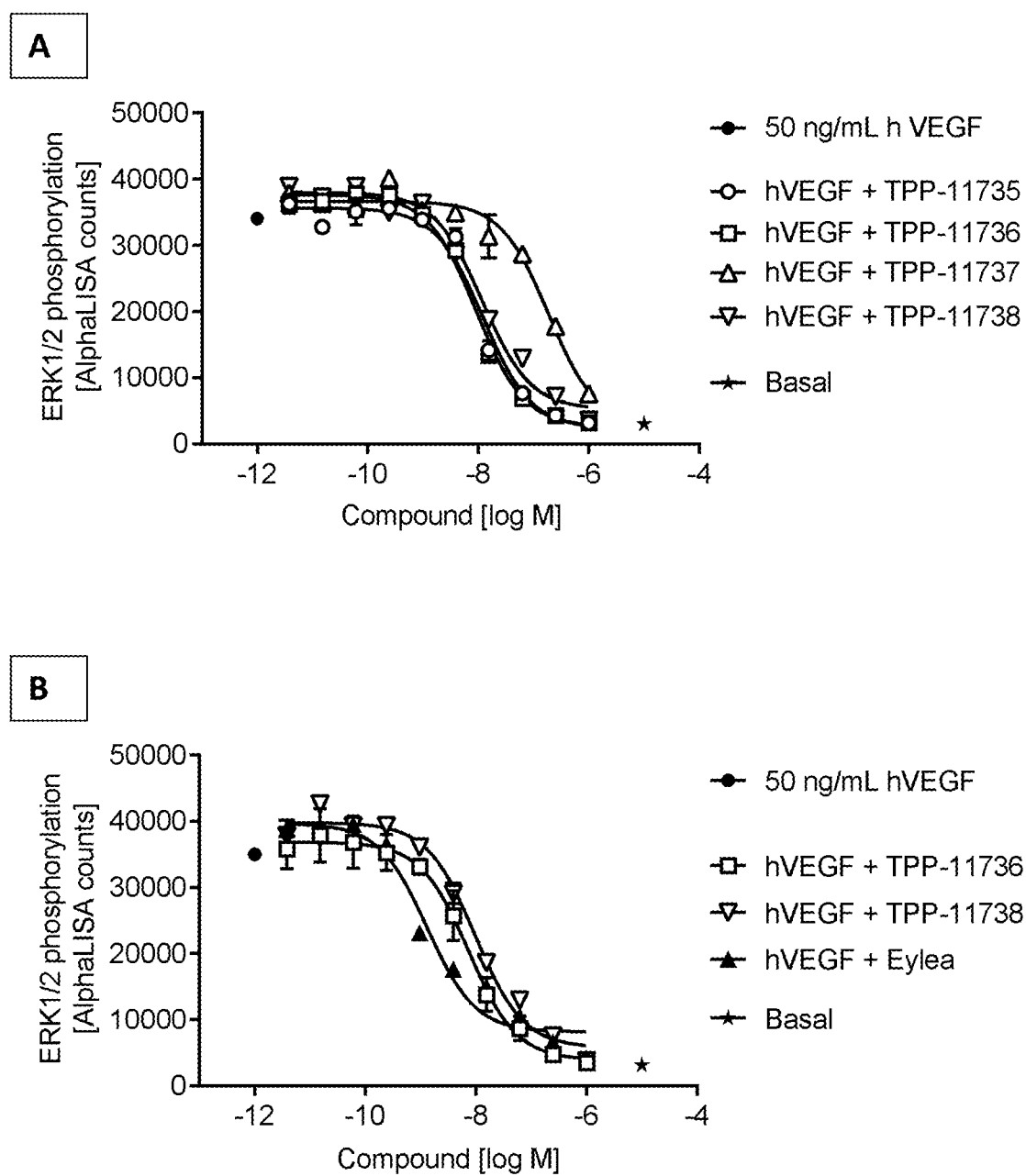
FIG. 9 A-B: VEGF-A scavenging was assessed by ERK1/2 phosphorylation (T202/Y204—ERK1) (T185/Y187—ERK2). For this purpose, human retinal microvascular endothelial cells (HRMECs) were starved and then incubated with 50 ng/mL human VEGF with or without pre-incubation with growing concentrations of the indicated molecules. (A) Comparison of Doppelmabs TPP-11735, -736, -737 and -738. (B) Comparison of TPP-11736, -738 with EYLEA® (aflibercept). Non-stimulated cells (Basal) and 50 ng/ml human VEGF without antibody treatment served as control. Data represent mean+/−SEM.
Figure 10:
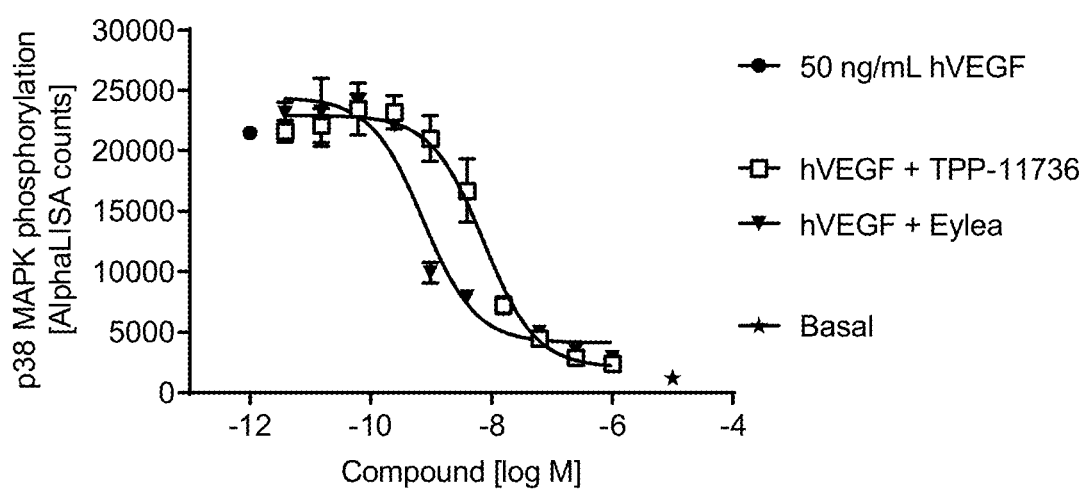
FIG. 10: VEGF-A scavenging was assessed by measuring p38 MAPK phosphorylation (T180/Y182). For this purpose, human retinal microvascular endothelial cells (HRMECs) were starved and then incubated with 50 ng/mL human VEGF with or without pre-incubation with growing concentrations of the indicated molecules. Non-stimulated cells (Basal) and 50 ng/ml human VEGF without antibody treatment served as control. Data represent mean+/−SEM.
Figure 12:
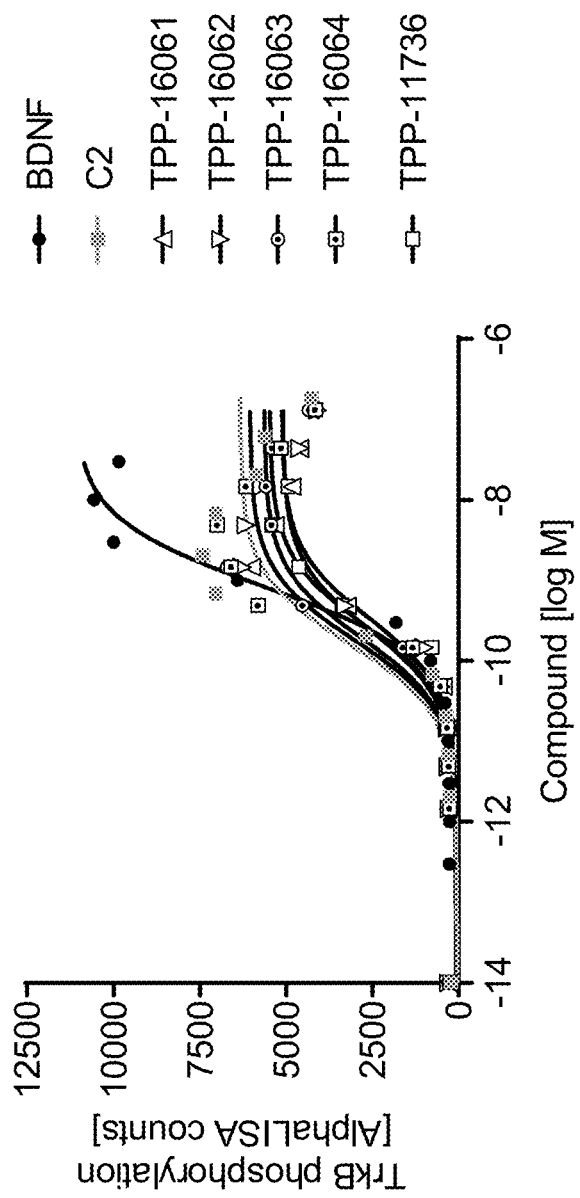
FIG. 12: TrkB phosphorylation (Y706/707) was measured in CHO cells stably expressing human TrkB after incubation with growing concentrations of the indicated molecules. Data represent mean+/−SEM.
Figure 13:
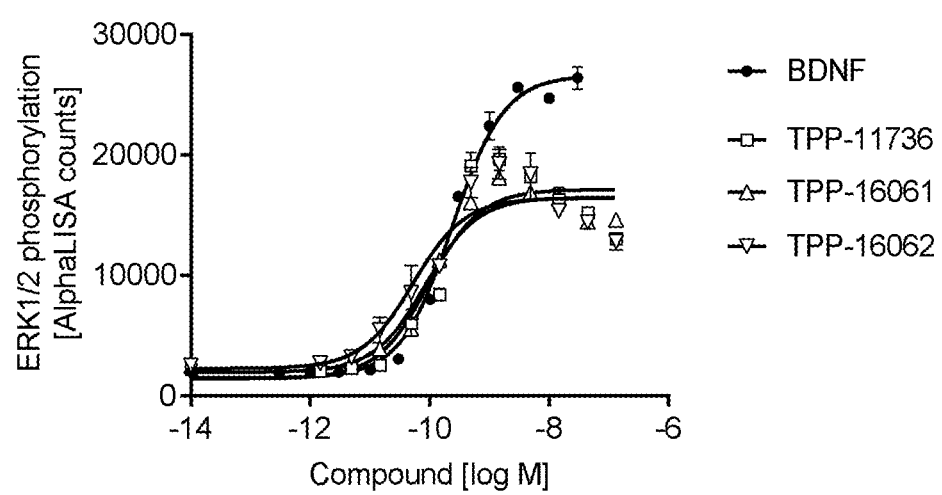
FIG. 13: ERK1/2 phosphorylation (T202/Y204—ERK1) (T185/Y187—ERK2) was measured in CHO cells stably expressing human TrkB after incubation with growing concentrations of the indicated molecules. Data represent mean+/−SEM.
Figure 14:
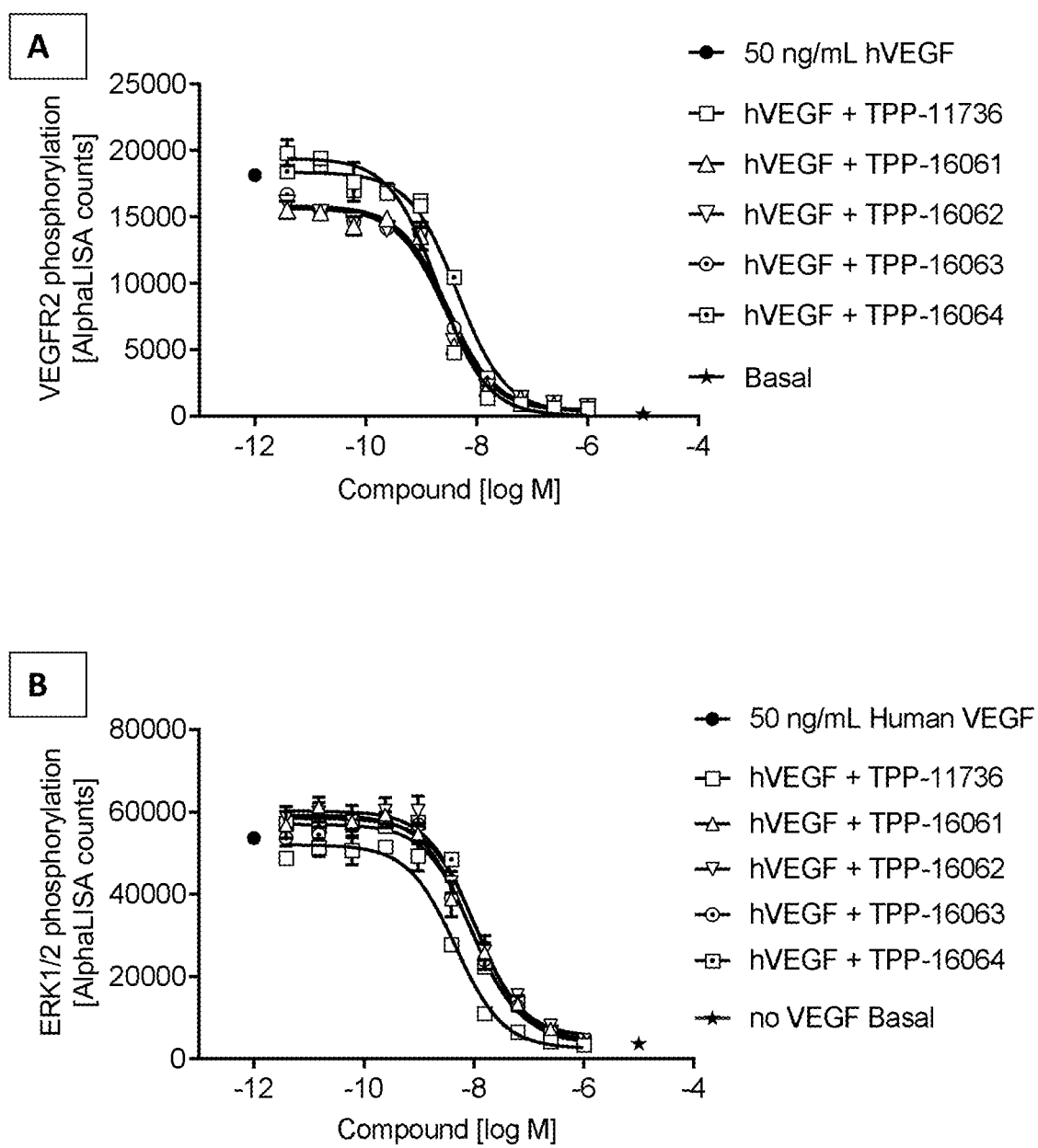
FIG. 14 A-B: VEGF-A scavenging was assessed by measuring (A) VEGF receptor 2 phosphorylation (Y1175) or (B) ERK1/2 phosphorylation (T202/Y204—ERK1) (T185/Y187—ERK2). For this purpose, human retinal microvascular endothelial cells (HRMECs) were starved and then incubated with 50 ng/mL human VEGF with or without pre-incubation with growing concentrations of the indicated molecules. Non-stimulated cells (Basal) and 50 ng/ml human VEGF without molecule treatment served as control. Data represent mean+/−SEM.
Figure 15:
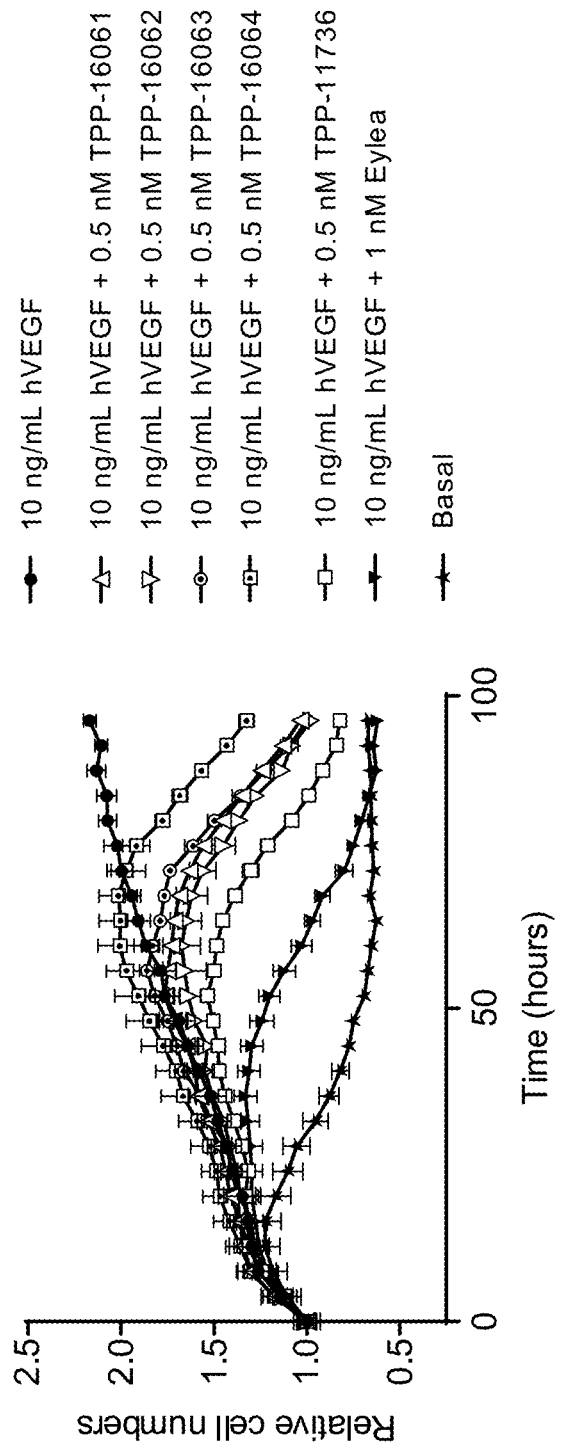
FIG. 15: VEGF-A scavenging was assessed by image-based quantification of HRMEC cell numbers. For this purpose, human retinal microvascular endothelial cells (HRMECs) were starved and then incubated with 10 ng/mL human VEGF with or without pre-incubation with 0.5 nM Doppelmabs or 1 nM EYLEA® (aflibercept). Images were recorded every four hours for a total period of 96 hours. Relative cell numbers are shown. Cell numbers at t=0 were set to one. Non-stimulated cells served as control (Basal). Data represent mean+/−SEM.
Figure 16:
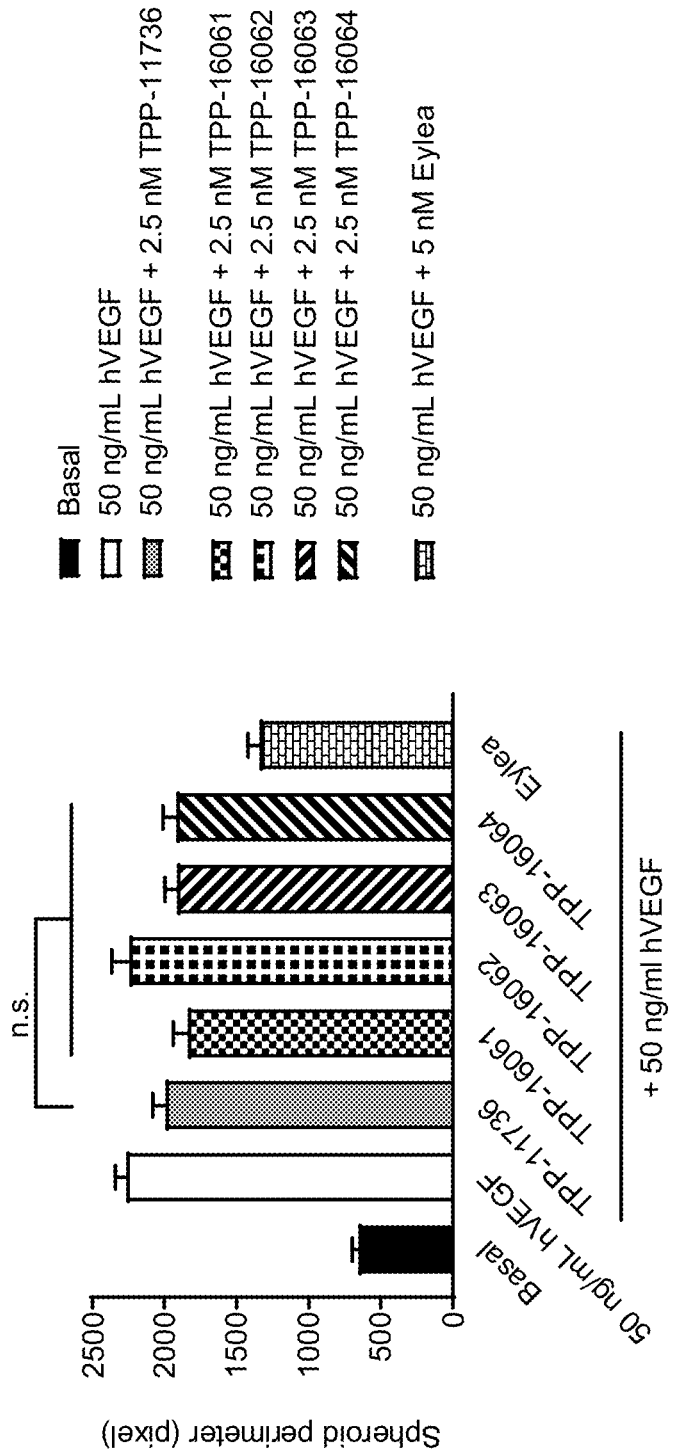
FIG. 16: Endothelial sprouting was assessed by confocal microscopy and displayed spheroid perimeter obtained from maximum projections of Z-stacks. For this purpose, spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of the indicated Doppelmabs or 5 nM EYLEA® (aflibercept) for 24 hours. Non-stimulated cells served as control (Basal). Data represent mean+/−SEM. n FIG. 17 A-C: VEGF-A scavenging was assessed by measuring (A) VEGF receptor 2 phosphorylation (Y1175), (B) ERK1/2 phosphorylation (T202/Y204—ERK1) (T185/Y187—ERK2), or (C) p38 MAPK phosphorylation (T180/Y182). For this purpose, human retinal microvascular endothelial cells (HRMECs) were starved and then incubated with 50 ng/mL human VEGF with or without pre-incubation with growing concentrations of Doppelmab TPP-11736 or TPP-13788 (B20 IgG). 50 ng/ml human VEGF without antibody treatment served as control. Data represent mean+/−SEM.
Figure 18:
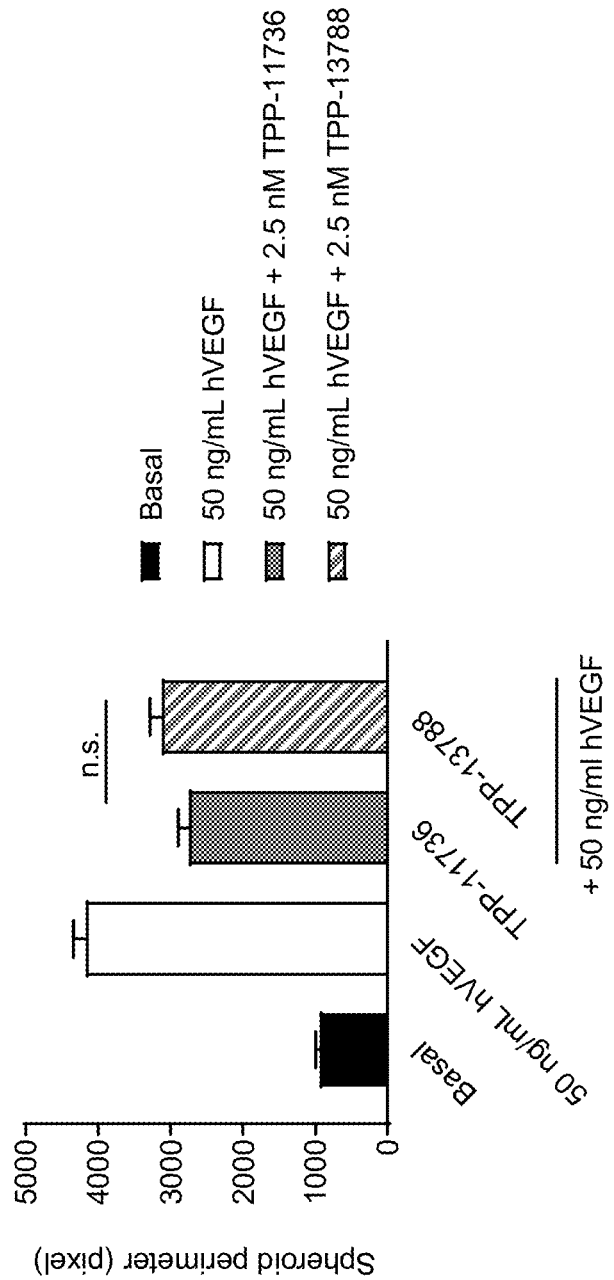
FIG. 18: Endothelial sprouting was assessed by confocal microscopy and displayed spheroid perimeter obtained from maximum projections of Z-stacks. For this purpose, spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of Doppelmab TPP-11736 or 2.5 nM TPP-13788 (B20 IgG). Non-stimulated cells served as control (Basal). Data represent mean+/−SEM.
Figure 19:
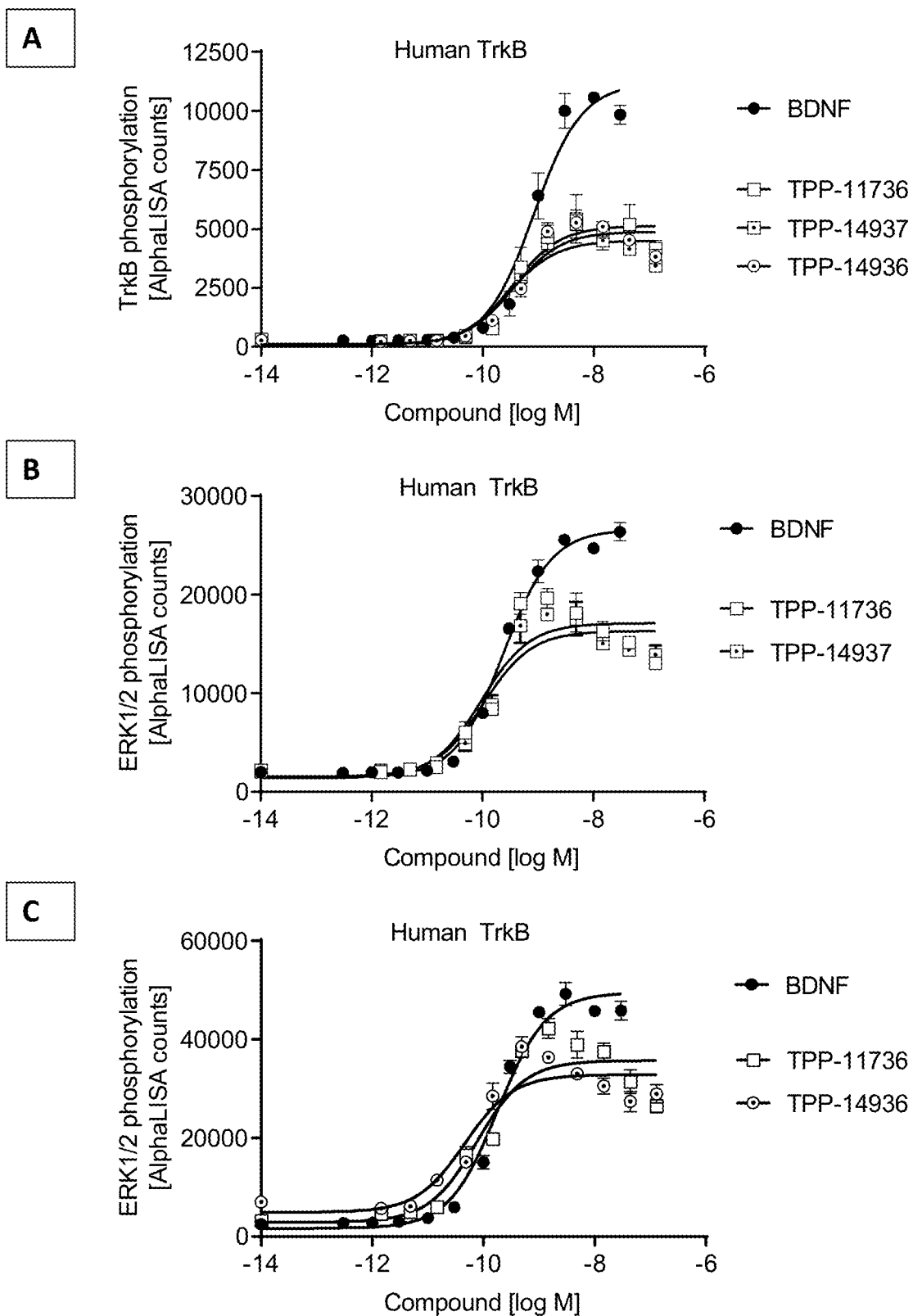
FIG. 19 A-C: (A) TrkB phosphorylation (Y706/707) or (B & C) ERK1/2 phosphorylation (T202/Y204—ERK1) (T185/Y187—ERK2) was measured in CHO cells stably expressing human TrkB after incubation with growing concentrations of the indicated molecules. Data represent mean+/−SEM.
Figure 20:
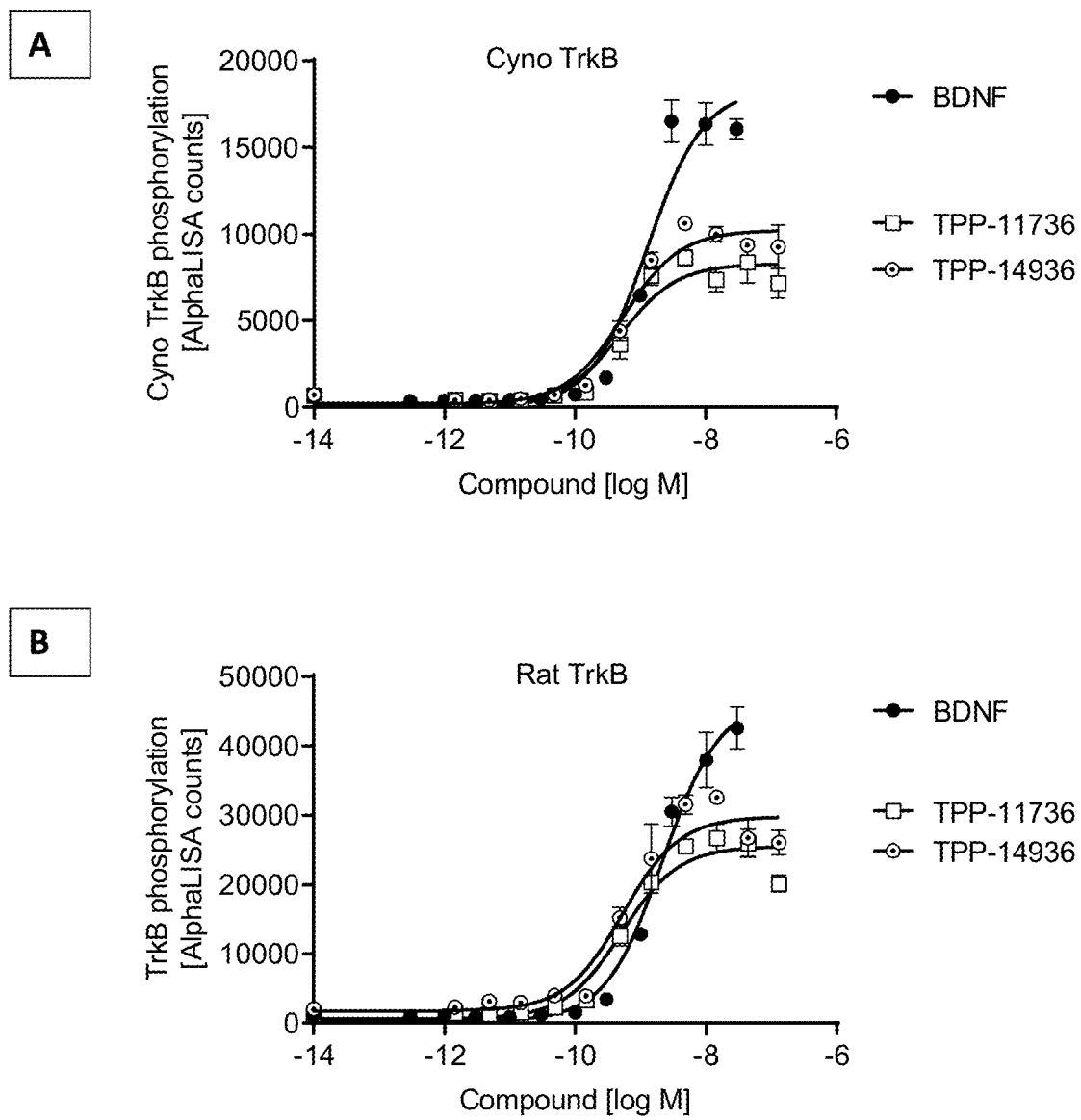
FIG. 20 A-B: TrkB phosphorylation (Y706/707) was measured in CHO cells stably expressing (A) cyno TrkB or (B) rat TrkB after incubation with growing concentrations of the indicated molecules. Data represent mean+/−SEM.
Figure 21:
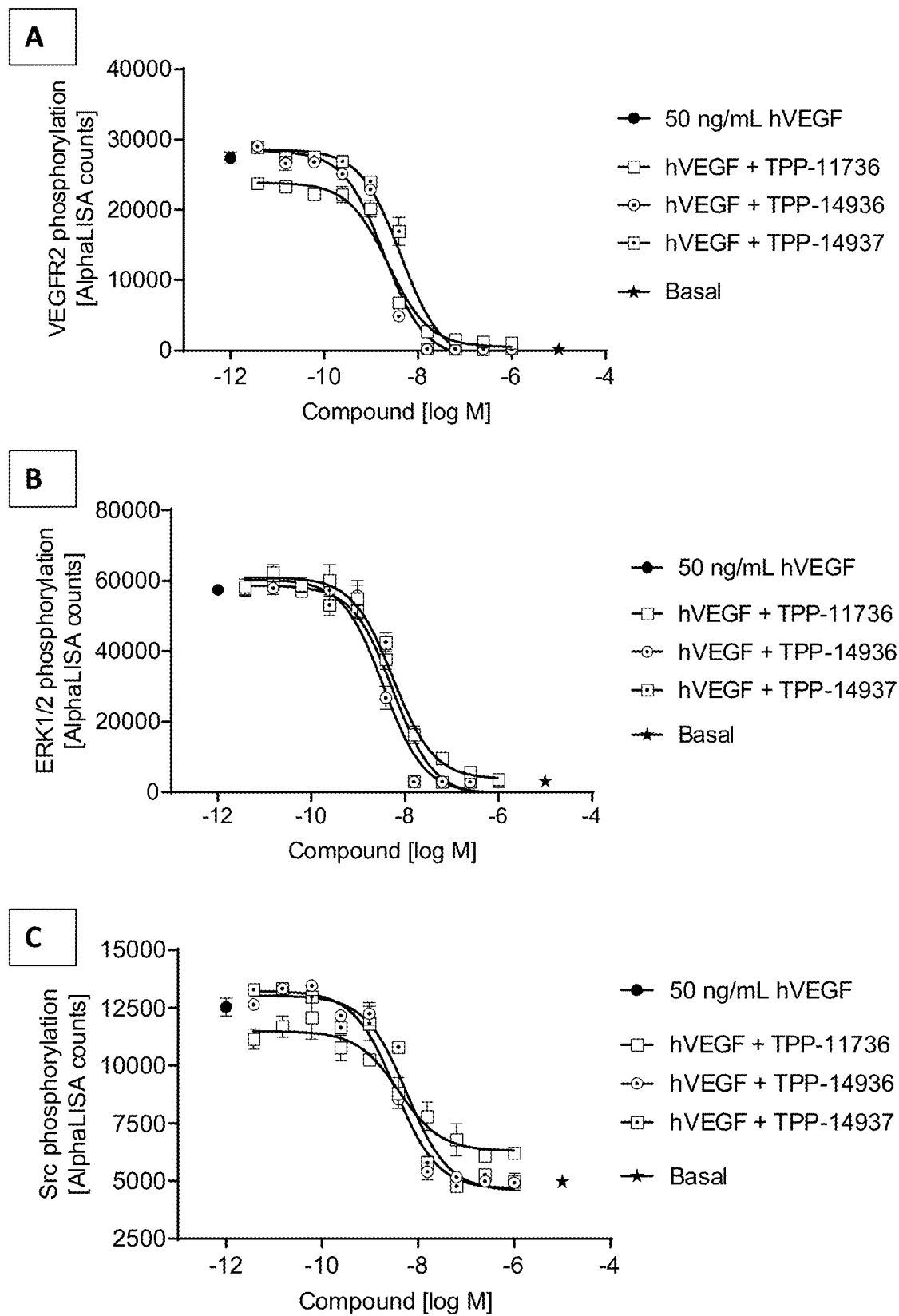
FIG. 21 A-C: VEGF-A scavenging was assessed by measuring (A) VEGF receptor 2 phosphorylation (Y1175), (B) ERK1/2 phosphorylation (T202/Y204—ERK1) (T185/Y187—ERK2) or (C) Src phosphorylation (Y419). For this purpose, human retinal microvascular endothelial cells (HRMECs) were starved and then incubated with 50 ng/mL human VEGF with or without pre-incubation with growing concentrations of the indicated molecules. 50 ng/ml human VEGF without antibody treatment served as control. Data represent mean+/−SEM.
Figure 22:
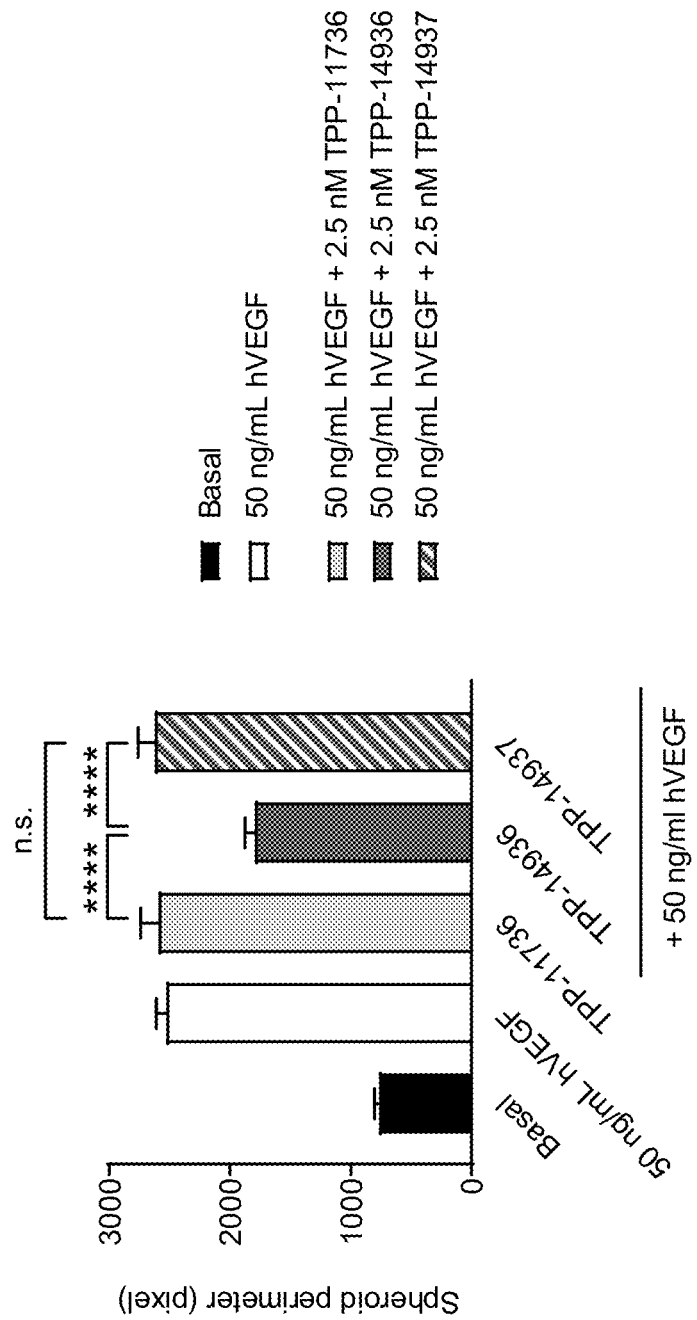
FIG. 22: Endothelial sprouting was assessed by confocal microscopy and displayed spheroid perimeter obtained from maximum projections of Z-stacks. For this purpose, spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of the indicated molecules. Non-stimulated cells served as control (Basal). Data represent mean+/−SEM. n.s. p>0.05 non-significant, ****p<0.0001.
Figure 23:
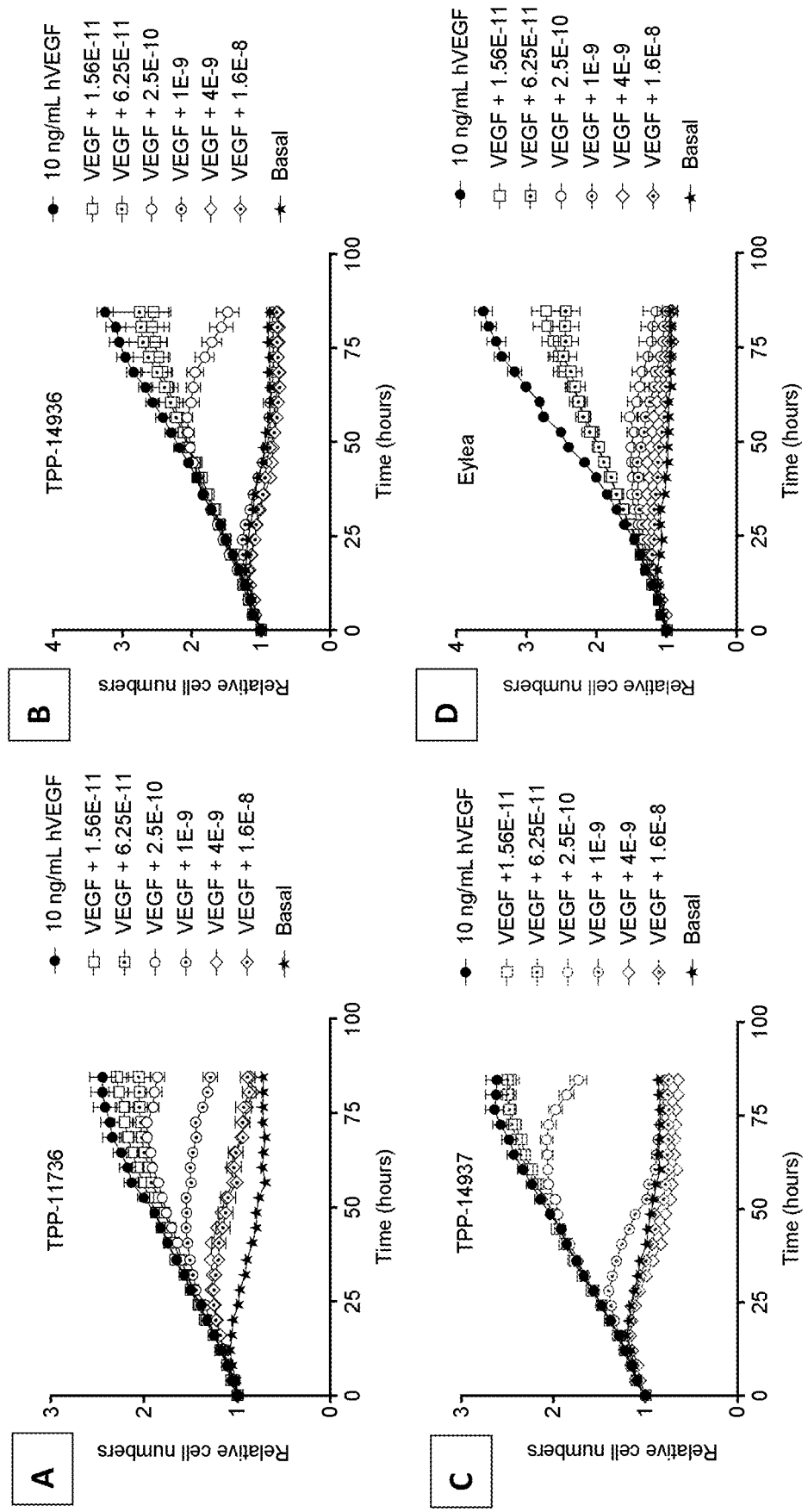
FIG. 23 A-D: VEGF-A scavenging was assessed by image-based quantification of HRMEC cell numbers. For this purpose, human retinal microvascular endothelial cells (HRMECs) were starved and then incubated with 10 ng/mL human VEGF with or without pre-incubation with growing concentrations indicated molecules: (A) TPP-11736, (B) TPP-14936, (C) TPP-14937, or (D) EYLEA® (aflibercept). Binding molecule/EYLEA® (aflibercept) concentrations are given in mol/L. Images were recorded every four hours for a total period of 84 hours. Relative cell numbers are shown. Cell numbers at t=0 were set to one. Non-stimulated cells served as control (Basal). Data represent mean+/−SEM.
Figure 24:
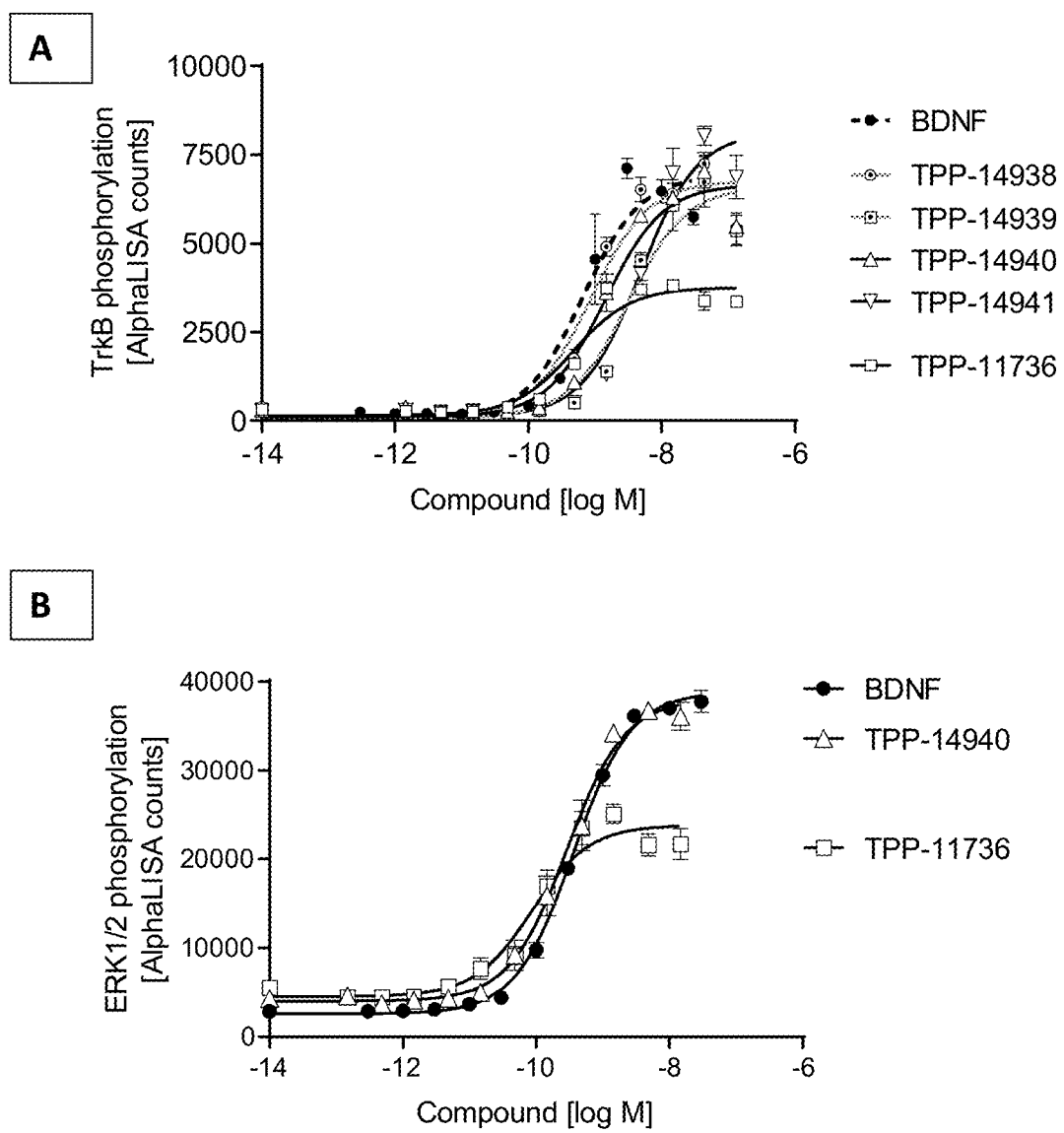
FIG. 24 A-B: (A) TrkB phosphorylation (Y706/707) or (B) ERK1/2 phosphorylation (T202/Y204—ERK1) (T185/Y187—ERK2) was measured in CHO cells stably expressing human TrkB after incubation with growing concentrations of the indicated molecules of the second series. Data represent mean+/−SEM.

Neuroprotective function of TrkB activation in a rat model of diabetes-induced retinal neurodegeneration using IVT injection of an agonistic TrkB tool antibody (C2) as well as Doppelmab TPP-11736. Animals were treated with STZ to induce hyperglycemia. The retinal function was assessed by electroretinography (ERG) before and after treatment. Diabetes induction led to delayed implicit times within 3 weeks after STZ treatment. At this point in time, animals were intravitreally dosed with an isotype control antibody (anti-TNP) or C2 (19 μg/5 μl, each), or an equimolar amount of TPP-11736 (25 μg/5 μl). After two weeks of treatment, ERG recordings were repeated and analyzed. Rod-driven B-wave implicit time delays immediately before and two weeks after intravitreal application of the antibodies are shown in FIG. 7; mean+/−SEM; $^{n.s.}$p>0.05, non-significant; p<0.01; *p<0.001; one-way Anova with Tukey multi-comparison test.

Results:

Two weeks after administration, anti-TNP antibody treatment did not reduce diabetes induced rod driven b-wave implicit time as compared to the point in time before anti-TNP treatment (15.4 ms at t=2 weeks vs. 13.3 ms at t=0; p>0.05, non-significant).

Two weeks after administration, TPP-11736 and C2 treated animals showed a significant reduction in diabetes induced rod driven b-wave implicit time delay as compared to the point in time before antibody treatment (C2: 8.62 ms at t=2 weeks vs. 14.4 ms at t=0; *p<0.01; TPP-11736 10.3 ms at t=2 weeks vs. 16.1 ms at t=0; p<0.01).

In agreement with the earlier measurements in in vitro assays of TrkB activation, C2 and TPP-11736 showed a similar neuroprotective efficacy in vivo.

Example 9

Comparison of the Human VEGF-A Scavenging by EYLEA® (Aflibercept) and the Four Doppelmabs TPP-11735, 736, 737 and 738 of the First Series—Inhibition of VEGF-Induced VEGFR2 Phosphorylation

FIG. 8 A-B

Human retinal microvascular endothelial cells (HRMECs) were starved and then incubated with 50 ng/mL human VEGF with or without pre-incubation with growing concentrations of the indicated binding molecules or EYLEA® (aflibercept).

VEGF-A scavenging was assessed by measuring VEGF receptor 2 (VEGFR2) phosphorylation on Y1175. (A) Comparison of Doppelmabs TPP-11735, -736, -737 and -738. (B) Comparison of TPP-11736 and TPP-11738 with EYLEA® (aflibercept). Non-stimulated cells (Basal) and 50 ng/ml human VEGF without antibody treatment served as control. Data represent mean+/−SEM.

Results:

TPP-11737 vs. TPP-11738: These molecules had both the G6 anti-VEGF molecule as scFv. 737 is connected in a VH-VL orientation, whereas 738 has the VL-VH orientation. It turned out that the VL-VH orientation worked a lot better based on the G6 anti-VEGF antibody.

TPP-11735 vs. TPP-11736: These molecules had both the B20 anti-VEGF molecule as scFv. For the B20 VEGF antibody in this assay, there was not much of a performance difference between the two orientations.

TPP-11736 vs. TPP-11738: These molecules had either the B20 (VL-VH) or the G6 (VL-VH) anti-VEGF molecule as scFv. Both binding molecules showed similar potency (IC50 ~4 nM), but TPP-11736 was more efficacious.

EYLEA® (aflibercept) (IC50=0.7 nM) is more potent than compared to either TPP-11736 or TPP-11738 (~4 nM).

Example 10

Comparison of Human VEGF-A Scavenging by EYLEA® (Aflibercept) and the Four Doppelmabs TPP-11735, 736, 737 and 738 of the First Series—Inhibition of VEGF-Induced ERK1/2 Phosphorylation

FIG. 9 A-B

Human retinal microvascular endothelial cells (HRMECs) were starved and then incubated with 50 ng/mL human VEGF with or without pre-incubation with growing concentrations of the indicated antibodies or EYLEA® (aflibercept).

VEGF-A scavenging was assessed by TrkB activation was assessed by measuring ERK1/2 phosphorylation on T202/Y204 (ERK1) and T185/Y187 (ERK2). (A) Comparison of Doppelmabs TPP-11735, -736, -737 and -738. (B) Comparison of TPP-11736, -738 with EYLEA® (aflibercept). Non-stimulated cells (Basal) and 50 ng/ml human VEGF without antibody treatment served as control. Data represent mean+/−SEM.

Results:

TPP-11737 vs. TPP-11738: These molecules had both the G6 anti-VEGF molecule as scFv. 737 is connected in a VH-VL orientation, whereas 738 has the VL-VH orientation. It turned out that the VL-VH orientation worked a lot better based on the G6 anti-VEGF antibody.

TPP-11735 vs. TPP-11736: These molecules had both the B20 anti-VEGF molecule as scFv. For the B20 VEGF antibody in this assay, there was not much of a performance difference between the two orientations.

TPP-11736 vs. TPP-11738: These molecules had either the B20 (VL-VH) or the G6 (VL-VH) anti-VEGF molecule as scFv. Both binding molecules showed similar potency (IC50 ~4 nM), but TPP-11736 was more efficacious.

EYLEA® (aflibercept) (IC50=2 nM) is more potent than compared to either TPP-11736 or TPP-11738 (~10 nM).

Example 11

Comparison of the Human VEGF-A Scavenging by EYLEA® (Aflibercept) and the Doppelmab TPP-11736 of the First Series—Inhibition of VEGF-Induced p38 MAPK Phosphorylation

FIG. 10

Human retinal microvascular endothelial cells (HRMECs) were starved and then incubated with 50 ng/mL human VEGF with or without pre-incubation with growing concentrations of TPP-11736 or EYLEA® (aflibercept). VEGF-A scavenging was assessed by measuring p38 MAPK phosphorylation on T180/Y182. Non-stimulated cells (Basal) and 50 ng/ml human VEGF without antibody treatment served as control. Data represent mean+/−SEM.

Results:

EYLEA® (aflibercept) ($IC_{50}$=~0.74 nM) was around 10-times more potent than TPP-11736 (~7.4 nM)

Example 12

Comparison of the Human VEGF-A Scavenging by the Four Doppelmabs TPP-11735, 736, 737 and 738 of the First Series and EYLEA® (Aflibercept)—Inhibition of VEGF-Induced HRMEC Proliferation

FIG. 11 A-E

Human retinal microvascular endothelial cells (HRMECs) were starved and then incubated with 10 ng/mL human VEGF with or without pre-incubation with growing concentrations of the indicated binding molecules or EYLEA® (aflibercept). Molecule concentrations are given in mol/L. VEGF-A scavenging was assessed by automated, image-based quantification of HRMEC cell numbers (IncuCyte). Images were recorded every four hours for a total period of 96 hours. Relative cell numbers are shown. Cell numbers at t=0 were set to one. Non-stimulated cells served as control (Basal). Data represent mean+/−SEM.

Results:

TPP-11737 vs. TPP-11738: These molecules have both the G6 anti-VEGF molecule as scFv. TPP-11737 is connected in a VH-VL orientation, whereas TPP-11738 has a VL-VH orientation. Obviously, the VL-VH orientation worked a lot better in the case of G6. There is virtually no effect of TPP-11737.

TPP-11735 (VH-VL) vs. TPP-11736 (VL-VH): These molecules have both the B20 anti-VEGF molecule as scFv. Again, the VL-VH orientation performed better.

736 vs. 738: B20 (VL-VH) vs. G6 (VL-VH): In this assay the TPP-11736 (B20) was clearly more efficacious Finally, EYLEA® (aflibercept) was more efficacious than TPP-11736.

Summary of Findings Series 1—TPP-11735, TPP-11736, TPP-11737, TPP-11738

TrkB Activation:

TrkB activation by DMabs was virtually identical to the parental C2 molecule. This was not unexpected since the entire (Fab)$_2$ portion of the C2 TrkB binder was incorporated into the DMabs without changing the sequence or the orientation/layout. Also, all Doppelmabs (and C2) were only partial TrkB agonists.

VEGF-Scavenging:

Apparently, the VL-VH orientation worked better for G6 and B20 as VEGF binders and B20 (VL-VH) was more efficacious than G6 (VL-VH). Also, both Doppelmabs (B20 and G6) were inferior to EYLEA® (aflibercept) in vitro.

Based on these initial findings the inventors set out to generate and test in the following examples different linkers for B20 in VL-VH orientation to improve VEGF-scavenging of Doppelmabs (TPP-16061 to TPP-16064).

Example 13

Comparison of Human TrkB Activation by C2, BDNF and the Four Doppelmabs TPP-16061, 16062, 16063 and 16064 of the First Series; TrkB Phosphorylation

FIG. 12

CHO cells with stable expression of human TrkB were incubated with growing concentrations of the natural TrkB ligand BDNF, the C2 antibody, TPP-11736 (B20, scFv, 20L3, VL-VH), or four Doppelmabs with different linkers TPP-16061 (B20, scFv, 20L1, VL-VH), TPP-16062 (B20, scFv, 15L1, VL-VH), TPP-16063 (B20, scFv, 10L1, VL-VH), TPP-16064 (B20, scFv, 6GS, VL-VH). TrkB activation was assessed by measuring TrkB phosphorylation on Y706/707. The lowest compound concentration was solvent alone. Data represent mean. For clarity, error bars were omitted.

Results:

TrkB activation by DMabs TPP-16061 to 16064 was virtually identical to the parental C2 molecule and TPP-11736. TrkB activation appeared to be largely independent of the linker variations between the Fc and the scFv (anti-VEGF) portion of the protein. Although this was expected—because the linkers were located distant to the TrkB (Fab)$_2$ fragment between the Fc and the scFv (anti-VEGF) portion of the protein—this was nonetheless a good confirmation that different linkers can be utilized without impacting the activity of the binding molecule. Finally, all displayed binding molecules only showed partial TrkB agonist activity.

Example 14

Comparison of Human TrkB Activation by BDNF, TPP-11736 and the Two Doppelmabs TPP-16061 & 16062 of First Series; ERK1/2 Phosphorylation

FIG. 13

CHO cells with stable expression of human TrkB were incubated with growing concentrations of the natural TrkB ligand BDNF, TPP-11736 (B20, scFv, 20L3, VL-VH), or two Doppelmabs with different linkers TPP-16061 (B20, scFv, 20L1, VL-VH) and TPP-16062 (B20, scFv, 15L1, VL-VH). TrkB activation was assessed by measuring ERK1/2 phosphorylation on T202/Y204 (ERK1) and T185/Y187 (ERK2). The lowest compound concentration was solvent alone. Data represent mean+/−SEM.

Results:

TrkB activation by DMabs TPP-16061 and 16062 was virtually identical to TPP-11736. Also here it showed that TrkB activation was largely independent of the linker variations and the displayed binding molecules showed only partial TrkB agonist activity.

Example 15

Comparison of the Human VEGF-A Scavenging by the Four Doppelmabs TPP-16061, 062, 063 and 064 of the First Series with TPP-11736—(A) Inhibition of VEGF-Induced VEGFR2 Phosphorylation, (B) ERK1/2 Phosphorylation

FIG. 14 A-B

Human retinal microvascular endothelial cells (HRMECs) were starved and then incubated with 50 ng/mL human VEGF with or without pre-incubation with growing concentrations of the indicated antibodies; TPP-11736 (B20, scFv, 20L3, VL-VH), or four Doppelmabs with different linkers TPP-16061 (B20, scFv, 20L1, VL-VH), TPP-16062 (B20, scFv, 15L1, VL-VH), TPP-16063 (B20, scFv, 10L1, VL-VH), TPP-16064 (B20, scFv, 6GS, VL-VH). VEGF-A scavenging was assessed by measuring (A) VEGF receptor 2 (VEGFR2) phosphorylation on Y1175 or (B) ERK1/2 phosphorylation on T202/Y204 (ERK1) and T185/Y187 (ERK2), respectively. Non-stimulated cells (Basal) and 50 ng/ml human VEGF without antibody treatment served as control. Data represent mean+/−SEM.

Results:

The variation of the linkers had virtually no impact on the potency or efficacy of VEGF-scavenging. This was somewhat unexpected—given that the linkers were located in proximity to the VEGF binding sites—but further confirmed that different linkers can be utilized without impacting the activity of the binding molecule.

Example 16

Comparison of the Human VEGF-A Scavenging by the Four Doppelmabs TPP-16061, 062, 063 and 064 of the First Series—Inhibition of VEGF-Induced HRMEC Proliferation

FIG. 15

Human retinal microvascular endothelial cells (HRMECs) were starved and then incubated with 10 ng/mL human VEGF with or without pre-incubation with 0.5 nM Doppelmabs or 1 nM EYLEA® (aflibercept). VEGF-A scavenging was assessed by automated, image-based quantification of HRMEC cell numbers (IncuCyte). Images were recorded every four hours for a total period of 96 hours. Relative cell numbers are shown. Cell numbers at t=0 were set to one. Non-stimulated cells served as control (Basal). Data represent mean+/−SEM.

Results:

Similar to the phosphorylation assays shown in example 15, the linker variants did not perform better (or worse) compared to the parental molecule TPP-11736. EYLEA® (aflibercept) was used at 1 nM because EYLEA® (aflibercept) was supposed to be a mono-valent molecule, whereas the Doppelmabs are bi-valent. Under these conditions, EYLEA® (aflibercept) performed better in inhibition of VEGF-induced proliferation of HRMEC.

Example 17

Comparison of the Human VEGF-A Scavenging by EYLEA® (Aflibercept), TPP-11736 and the Four Doppelmabs TPP-16061, 062, 063 and 064 of the First Series—Inhibition of VEGF-Induced HRMEC Sprouting

FIG. 16

Spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of the indicated Doppelmabs or 5 nM EYLEA® (aflibercept) for 24 hours. Endothelial sprouting was assessed by confocal microscopy and displayed spheroid perimeter obtained from maximum projections of Z-stacks. Non-stimulated cells served as control (Basal). Data represent mean+/−SEM. n.s. p>0.05 non-significant vs. 50 ng/mL hVEGF+2.5 nM TPP-11736.

Results:

Similar to the phosphorylation assays shown in example 15, the linker variants did not perform better (or worse) compared to the parental molecule TPP-11736. EYLEA® (aflibercept) was used at 1 nM because EYLEA® (aflibercept) is supposed to be a mono-valent molecule, whereas the Doppelmabs are bi-valent. Under these conditions, EYLEA® (aflibercept) performed better in inhibition of VEGF-induced proliferation of HRMEC.

Summary of Findings Series 1—TPP-16061, TPP-16062, TPP-16063, TPP-16064

TrkB activation: No difference/improvement compared to the parental molecule TPP-11736 was observed.

VEGF-scavenging: No difference/improvement compared to the parental molecule TPP-11736.

Based on these findings the inventors set out to compare the VEGF-scavenging of TPP-11736 (B20 as scFv) with TPP-13788 (B20 IgG) to test if reformatting of the B20 as a Fab would improve VEGF-scavenging.

Example 18

Comparison of the Human VEGF-A Scavenging by TPP-11736 and TPP-13788 (B20 IgG)—Inhibition of VEGF-Induced Phosphorylation of VEGFR2, ERK1/2 and p38 MAPK

FIG. 17 A-C

Human retinal microvascular endothelial cells (HRMECs) were starved and then incubated with 50 ng/mL human VEGF without or with pre-incubation with growing concentrations of Doppelmab TPP-11736 (B20 anti-VEGF as scFv) or TPP-13788 (B20 IgG). VEGF-A scavenging was assessed by measuring (A) VEGF receptor 2 (VEGFR2) phosphorylation on Y1175, (B) ERK1/2 phosphorylation on T202/Y204 (ERK1) and T185/Y187 (ERK2), or (C) p38 MAPK phosphorylation on T180/Y182. 50 ng/ml human VEGF without molecule treatment served as control. Data represent mean+/−SEM. The Table 4 below reports the corresponding best-fit $IC_{50}$ values (non-linear regression; log(agonist) vs. response (three parameters).

TABLE 4

|  | TPP-11736 | TPP-13788 |
|---|---|---|
| $IC_{50}$ (VEGFR2 phosphorylation) | 2.6 nM | 1.0 nM |
| $IC_{50}$ (ERK½ phosphorylation) | 9.1 nM | 3.0 nM |
| $IC_{50}$ (p38 MAPK phosphorylation) | 7.7 nM | 2.4 nM |

Results:

The tested B20 IgG TPP-13788 displays an approximately 3-fold increased VEGF-A scavenging potency vs. TPP-11736

Example 19

Comparison of the Human VEGF-A Scavenging by TPP-11736 and TPP-13788 (B20 IgG)—Inhibition of VEGF-Induced HRMEC Sprouting

FIG. 18

Spheroids of human retinal microvascular endothelial cells (HRMECs) were embedded in a collagen matrix.

Endothelial sprouting was induced for 24 hours by incubation with 50 ng/mL human VEGF without or with pre-incubation with 2.5 nM of Doppelmab TPP-11736 or 2.5 nM TPP-13788 (B20 IgG). Endothelial sprouting was assessed by confocal microscopy and displayed spheroid perimeter obtained from maximum projections of Z-stacks. Non-stimulated cells served as control (Basal). Data represent mean+/−SEM. n.s. p>0.05 non-significant vs. 50 ng/mL hVEGF+2.5 nM TPP-11736.

Results:

Despite the improvements of VEGF-scavenging in the VEGFR2, ERK1/2 and p38 MAPK phosphorylation assay, TPP-13788 (B20 IgG) mediated inhibition of VEGF-induced sprouting was not better than that of TPP-11736.

Example 20

Comparison of Human TrkB Activation by BDNF, TPP-11736 and the Two Doppelmabs TPP-14936 and TPP-14937 of the First Series; TrkB and ERK1/2 Phosphorylation

FIG. 19 A-C

CHO cells with stable expression of human TrkB were incubated with growing concentrations of the natural TrkB ligand BDNF, TPP-11736 (B20, scFv, 20L3, VL-VH), or two the Doppelmabs TPP-13936 (Ranibizumab, scFv, 20L3, VH-VL) or TPP-14937 (Ranibizumab, scFv, 20L3, VL-VH). TrkB activation was assessed by measuring (A) TrkB phosphorylation on Y706/707, (B & C) ERK1/2 phosphorylation on T202/Y204 (ERK1) and T185/Y187 (ERK2), respectively. The lowest compound concentration was solvent alone. Data represent mean+/−SEM.

Results:

TrkB activation by DMabs TPP-14936 and TPP-14937 was virtually identical to TPP-11736. This was expected since the TrkB-binding component of the binding molecules was always the C2 as Fab fragment.

Example 21

Comparison of Cyno and Rat TrkB Activation by BDNF, TPP-11736 and the Doppelmab TPP-14936; TrkB Phosphorylation

FIG. 20 A-B

CHO cells with stable expression of (A) cyno TrkB or (B) rat TrkB were incubated with growing concentrations of the natural TrkB ligand BDNF, TPP-11736 (B20, scFv, 20L3, VL-VH) or TPP-14936 (Ranibizumab, scFv, 20L3, VH-VL). TrkB activation was assessed by measuring TrkB phosphorylation on Y706/707. The lowest compound concentration was solvent alone. Data represent mean+/−SEM.

Results:

TrkB activation by DMab TPP-14936 was virtually identical to TPP-11736. Again, this is was expected since the TrkB-binding component of the two molecules is C2 as Fab fragment in both cases.

Example 22

Comparison of the Human VEGF-A Scavenging by TPP-11736, TPP-14936 or TPP-14937—Inhibition of VEGF-Induced Phosphorylation of VEGFR2, ERK1/2 and Src

FIG. 21 A-C

Human retinal microvascular endothelial cells (HRMECs) were starved and then incubated with 50 ng/mL human VEGF with or without pre-incubation with growing concentrations of the Doppelmabs TPP-11736 (B20, scFv, 20L3, VL-VH), TPP-14936 (Ranibizumab, scFv, 20L3, VH-VL) or TPP-14937 (Ranibizumab, scFv, 20L3, VL-VH). VEGF-A scavenging was assessed by measuring (A) VEGF receptor 2 (VEGFR2) phosphorylation on Y1175, (B) ERK1/2 phosphorylation on T202/Y204 and T185/Y187, or (C) Src phosphorylation on Y419. 50 ng/ml human VEGF without antibody treatment served as control. Data represent mean+/−SEM. The Table 5 below reports the corresponding best-fit $IC_{50}$ values and the absolute efficacy values (bottom plateau), respectively (non-linear regression; log(agonist) vs. response (three parameters).

TABLE 5

|  | TPP-11736 | TPP-14936 | TPP-14937 |
|---|---|---|---|
| $IC_{50}$ (VEGFR2 phosphorylation) | 2.4 nM | 1.9 nM | 4.3 nM |
| Bottom plateau (VEGFR2 phosphorylation; counts) | 482 | −1097 | −1407 |
| $IC_{50}$ (ERK½ phosphorylation) | 5.6 nM | 3.5 nM | 5.6 nM |
| Bottom plateau (ERK½ phosphorylation, counts) | 3688 | −340.8 | −926.9 |
| $IC_{50}$ (Src phosphorylation) | 4.0 nM | 3.4 nM | 5.8 nM |
| Bottom plateau (Src phosphorylation, counts) | 6300 | 4654 | 4571 |

Results:

Potency of VEGF-scavenging ($IC_{50}$) is similar between TPP-11736 and TPP-14936/TPP-14937.

Potency of VEGF-scavenging ($IC_{50}$) by TPP-14936 is somewhat better than TPP-14937→VH-VL better than VL-VH orientation of Ranibizumab scFv.

VEGF scavenging by TPP-14936 and TPP-14937 was more efficacious than TPP-11736 (bottom values were smaller).

Example 23

Comparison of the Human VEGF-A Scavenging by TPP-11736 and the Doppelmabs TPP-14936 and TPP-14937—Inhibition of VEGF-Induced HRMEC Sprouting

FIG. 22

Spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of Doppelmab TPP-11736 (B20, scFv, 20L3, VL-VH), TPP-14936 (Ranibizumab, scFv, 20L3, VH-VL) or TPP-14937 (Ranibizumab, scFv, 20L3, VL-VH). Endothelial sprouting was assessed by confocal microscopy and displayed spheroid perimeter obtained from maximum projections of Z-stacks. Non-stimulated cells served as control (Basal). Data represent mean+/−SEM. n.s. p>0.05 non-significant, ****p<0.0001.

Results:

Although VEGF-scavenging by TPP-14936 and TPP-14937 was similar in the VEGFR2/ERK1_2/Src phosphorylation assay, there were dramatic differences in the inhibition of VEGF-induced sprouting. No significant difference between TPP-11736 and TPP-14937, however, inhibition of VEGF-induced HRMEC sprouting by TPP-14936 was a lot more efficacious than TPP-14937 or TPP-11736.

This unexpected finding indicated that the VH-VL orientation of the anti-VEGF scFv is critical for the performance in this assay: VH-VL is much better than VL-VH. Interestingly, the VL-VH orientation was better than VH-VL in case of TPP-11735 vs. 736 (B20) and also in case of TPP-11737 vs. 738 (G6).

Example 24

Comparison of the Human VEGF-A Scavenging by the Doppelmabs TPP-11736, TPP-14936 and TPP-14937, and EYLEA® (Aflibercept)—Inhibition of VEGF-Induced HRMEC Proliferation

FIG. 23 A-D

Human retinal microvascular endothelial cells (HRMECs) were starved and then incubated with 10 ng/mL human VEGF with or without pre-incubation with growing concentrations of the indicated binding molecules or EYLEA® (aflibercept). Binding molecule/EYLEA® (aflibercept) concentrations are given in mol/L. VEGF-A scavenging was assessed by automated, image-based quantification of HRMEC cell numbers (IncuCyte). Images were recorded every four hours for a total period of 84 hours. Relative cell numbers are shown. Cell numbers at t=0 were set to one. Non-stimulated cells served as control (Basal). Data represent mean+/−SEM.

Results:

TPP-14936 and TPP-14937 displayed a better potency and especially efficacy of inhibition of VEGF-induced HRMEC proliferation compared to TPP-11736. TPP-14936 was more potent than TPP-14937.

Very surprisingly TPP-14936 and TPP-14937 were more efficacious than EYLEA® (aflibercept). Both Doppelmabs reduced the proliferation even below baseline. In contrast to EYLEA® (aflibercept), they showed full inhibition of VEGF-induced proliferation. However, EYLEA® (aflibercept) was still more potent than TPP-14936 and 14937.

Summary of Findings Series 1—TPP-14936/14937

TrkB activation: No difference/improvement compared to the TPP-11736 were observed. Since both binding molecules had the C2 binder as Fab fragment this was kind of expected.

VEGF-Scavenging:

Phosphorylation assay: Potency of VEGF-scavenging ($IC_{50}$) was similar between TPP-11736 and TPP-14936/TPP-14937. VEGF scavenging by TPP-14936 and TPP-14937 was more efficacious than TPP-11736 (bottom values).

Sprouting assay: No significant difference between TPP-11736 and TPP-14937. Inhibition of VEGF-induced HRMEC sprouting by TPP-14936 was a lot more efficacious than TPP-14937 or TPP-11736. Unexpectedly, VH-VL orientation of anti-VEGF Ranibizumab was much better than VL-VH.

Proliferation assay: TPP-14936 and TPP-14937 displayed a better potency and especially efficacy of inhibition of VEGF-induced HRMEC proliferation compared to TPP-11736. TPP-14936 was more potent than TPP-14937 and TPP-14936 and TPP-14937 were both more efficacious than EYLEA® (aflibercept).

Based on these findings the inventors set out to better understand the reverse layout of Doppelmabs and tried Ranibizumab/B20 as Fab to improve potency (efficacy) of VEGF-scavenging and the C2 TrkB binder as scFv. The following binding molecules were now generated and tested in the following examples (series 2): TPP-14938 (B20 Fab), TPP-14939 (B20 Fab), TPP-14940 (Ranibizumab Fab), TPP-14941 (Ranibizumab Fab).

Example 25

Comparison of Human TrkB Activation by BDNF, TPP-11736 and the Four Doppelmabs TPP-14938, TPP-14939, TPP-14940 and TPP-14941 of the Second Series; TrkB and ERK1/2 Phosphorylation

FIG. 24 A-B & FIG. 25

CHO cells with stable expression of human TrkB were incubated with growing concentrations of the natural TrkB ligand BDNF, TPP-11736 (C2 as Fab), or four Doppelmabs TPP-14938 (C2 as scFv, 20L3, VH-VL), TPP-14939 (C2 as scFv, 20L3, VL-VH), TPP-14940 (C2 as scFv, 20L3, VH-VL), and TPP-14941 (C2 as scFv, 20L3, VL-VH) of the second series. TrkB activation was assessed by (A) measuring TrkB phosphorylation on Y706/707 or by (B) measuring ERK1/2 phosphorylation on T202/Y204 (ERK1) and T185/Y187 (ERK2), respectively. The lowest compound concentration was solvent alone. Data represent mean+/−SEM.

Results:

TPP-11736 contained the C2 CDRs as Fabs. The four Doppelmabs TPP-14938, TPP-14939, TPP-14940 and TPP-14941 contained C2 as scFv.

Figure 25:
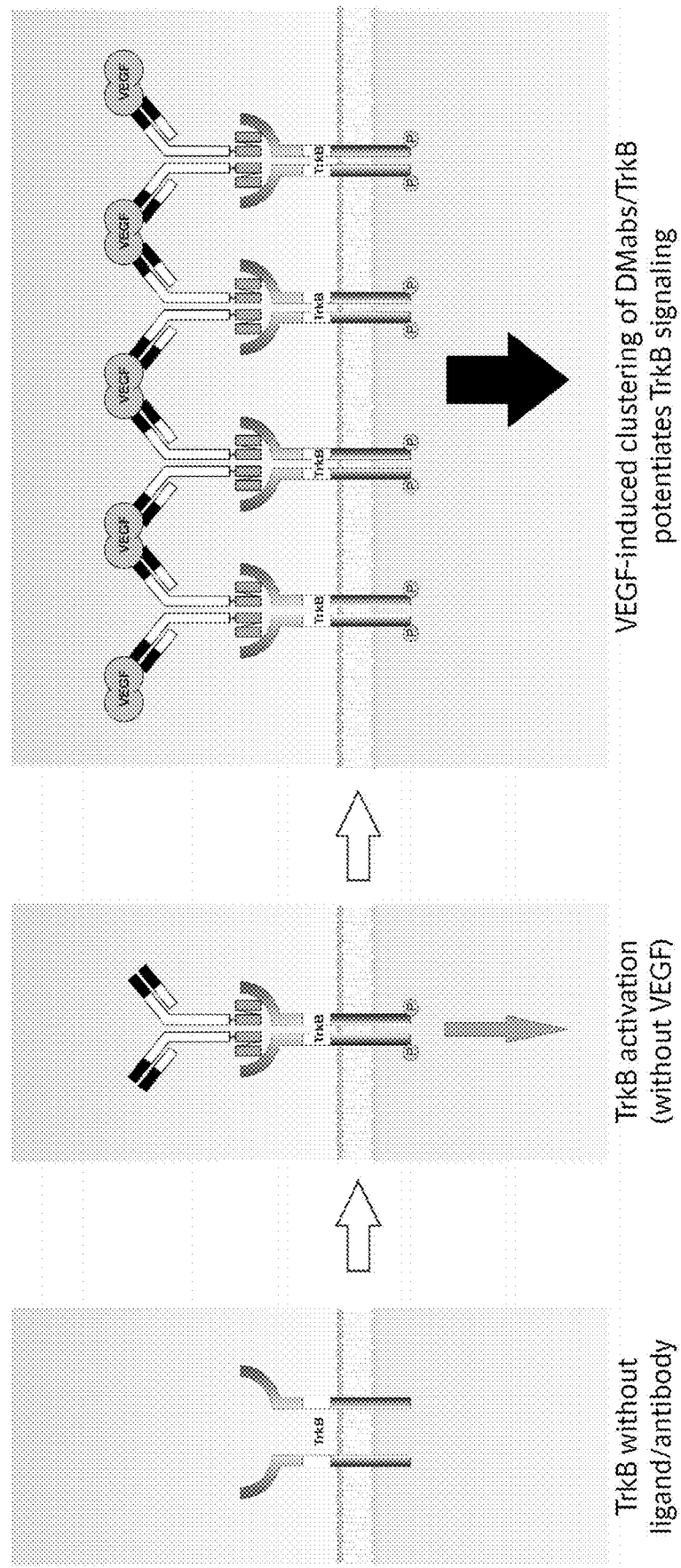
FIG. 25: Cartoon depicting the proposed underlying effect of VEGF induced clustering with the single binding molecules resulting in increased efficacy and potency of TrkB activation.
Figure 38:
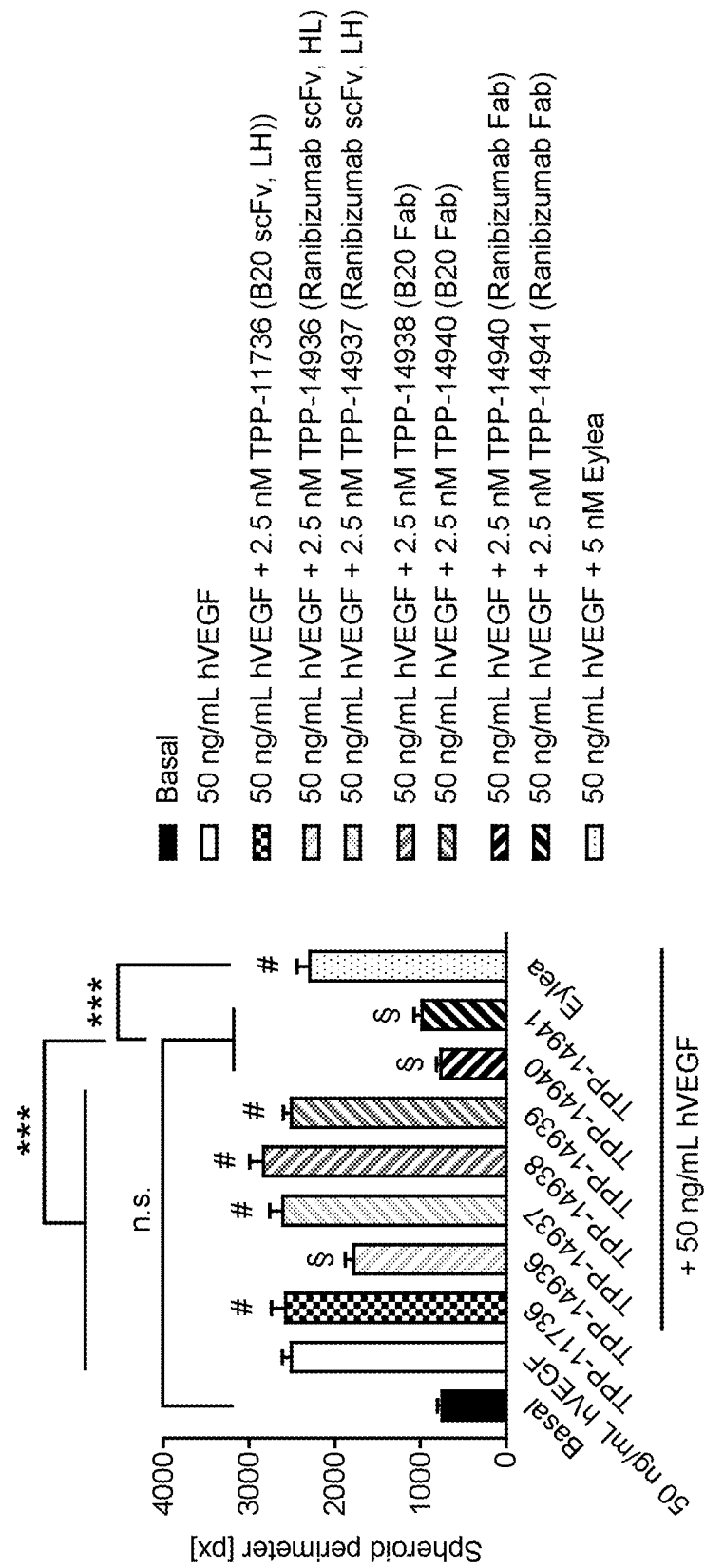
FIG. 38: Endothelial sprouting was assessed by confocal microscopy and displayed spheroid perimeter obtained from maximum projections of Z-stacks. For this purpose, spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of the indicated molecules. Non-stimulated cells served as control (Basal). Data represent mean+/−SEM. n.s. p>0.05 no significant difference; § p<0.0001 compared to 50 ng/mL hVEGF; #p>0.05 no significant difference compared to 50 ng/mL hVEGF. ***p<0.001; one-way Anova with Tukey multi comparison test.
Figure 39:
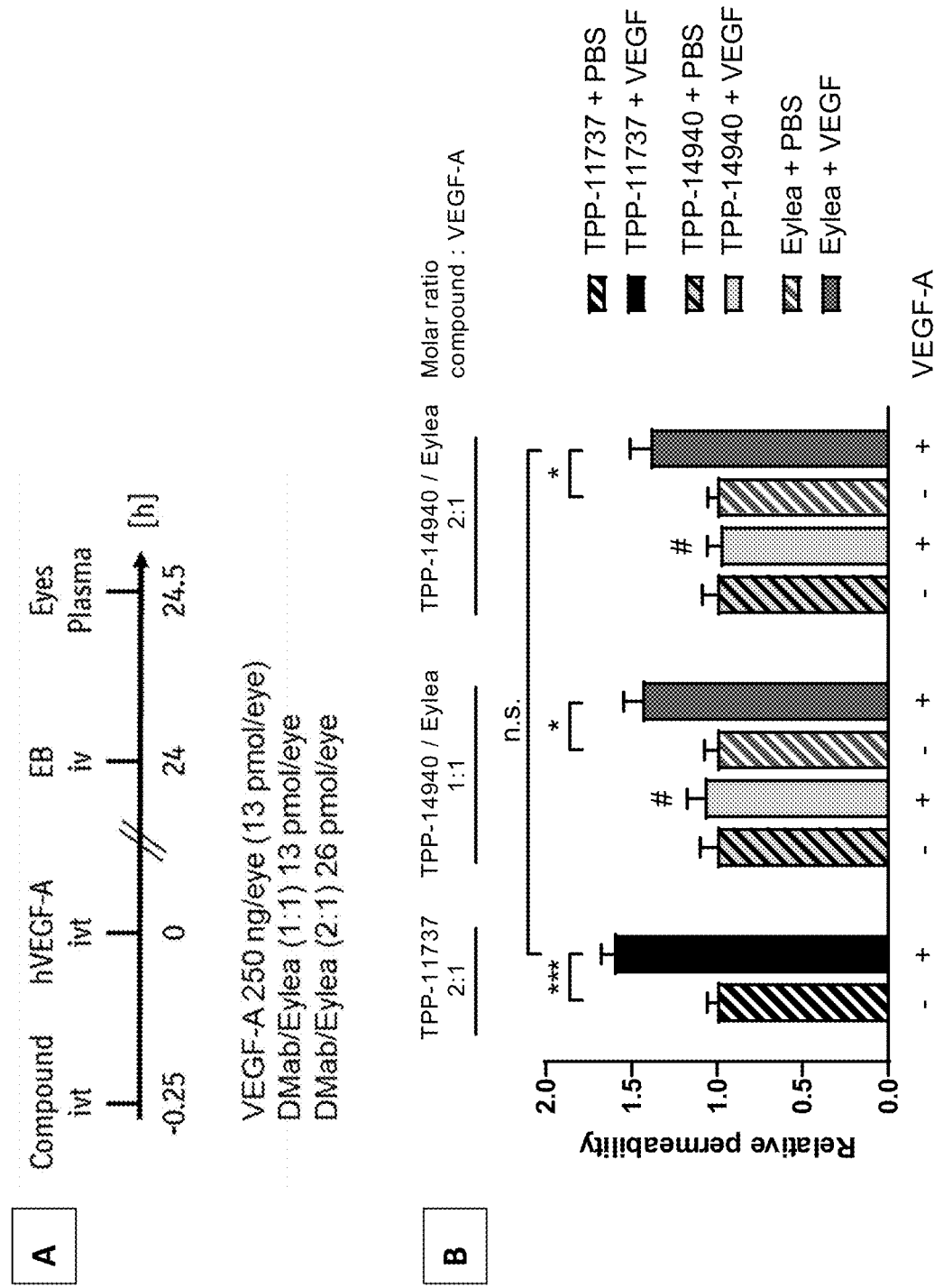
FIG. 39 A-B: (A) Time protocol showing the experimental procedure. Fifteen minutes after intravitreal (ivt) administration of the anti-VEGF compound (13 or 26 pmol per eye of EYLEA® (aflibercept) or TPP-14940) or the control (26 pmol TPP-11737), 13 pmol human VEGF-A per eye was administered by ivt injection. PBS injection served as control. Twenty-four hours later 1 mL/kg of an Evans Blue (EB) solution (45 mg/mL in 0.9% saline) were administered by intravenous (iv) injection for 30 minutes before the eyes were isolated and fixed. Plasma samples were collected at the same point in time to confirm equal systemic EB exposure. (B) Quantification of VEGF-A-induced hyperpermeability in the retinas of Brown Norway rats was done by measuring EB extravasation in retinal flatmounts by confocal microscopy. Eyes were cut along the Ora serrata, lens and vitreous were removed and the eye cup was fixed in paraformaldehyde (4%) for 1 h at 4° C. and then transferred to PBS overnight at 4° C. The retinae were separated from the outer segments (sclera and choroidea) and transferred to a glass slide and cut four times to achieve a flat cloverleaf-like structure. The tissue was covered with mounting medium (Vectashield H-1200 containing the DNA stain DAPI) and a coverslip was put on top to obtain a retinal flatmount. The samples were excited at a wavelength of 639 nm and emission of Evans Blue at 669 nm was recorded with a LSM 700 confocal laser scanning-microscope (Carl Zeiss, Jena; gain 800, laser strength 2%, 5 stacks of 60 μm) and images of the retinal flatmounts with maximum intensity projection were obtained. Analysis of fluorescence intensity sum was done after opening the images in the program ImageJ with a threshold of 30. ***p<0.001; *p<0.05; n.s. p>0.05; #p>0.05 non-significant vs. TPP-11737+PBS. One-way Anova with Tukey multi comparison test, n=9-17.
Figure 40:
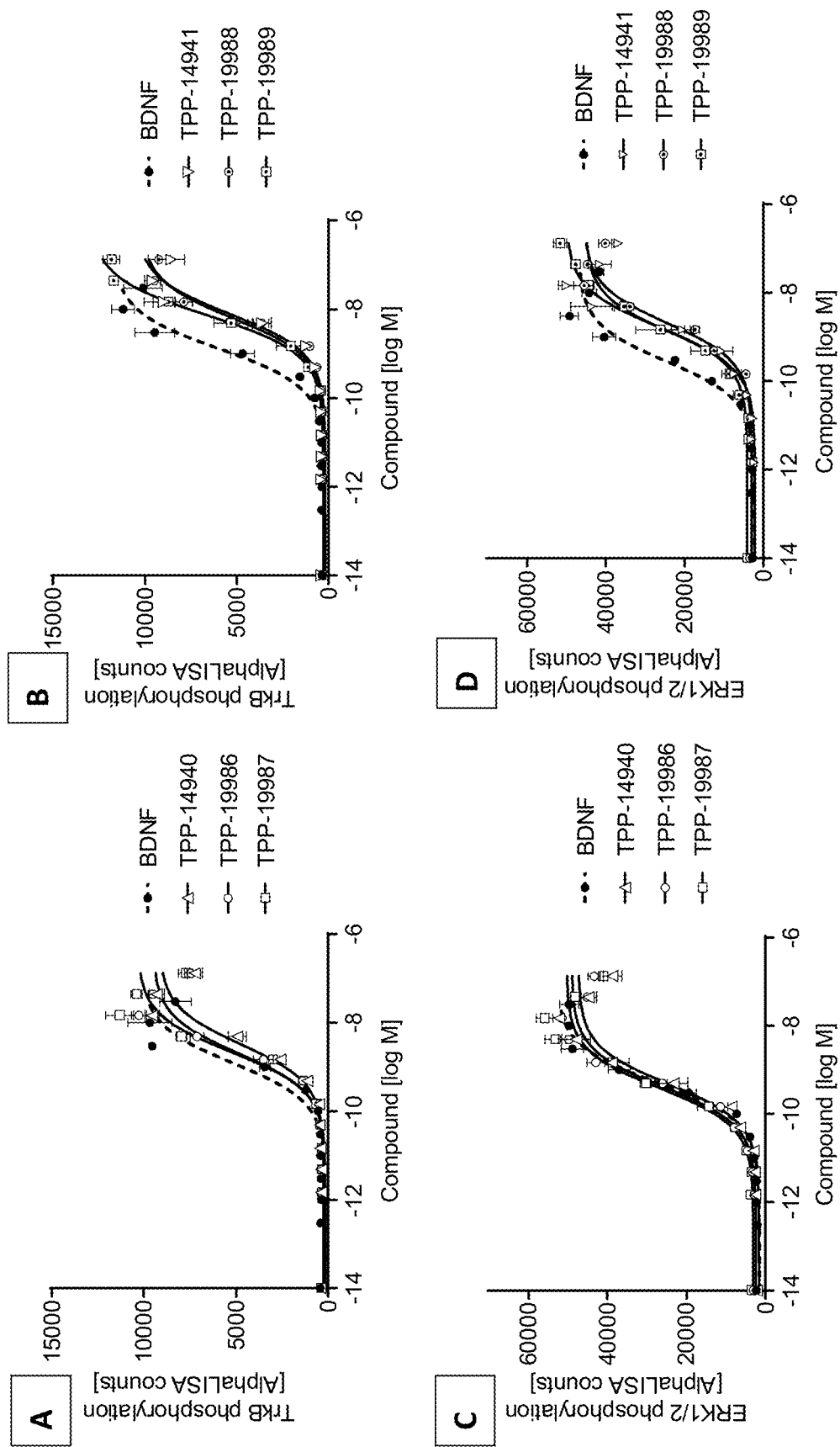
FIG. 40 A-D: (A & B) TrkB phosphorylation (Y706/707) or (C & D) ERK1/2 phosphorylation (T202/Y204—ERK1) (T185/Y187—ERK2) was measured in CHO cells stably expressing human TrkB after incubation with growing concentrations of BDNF or growing concentrations of the indicated molecules.
Figure 41:
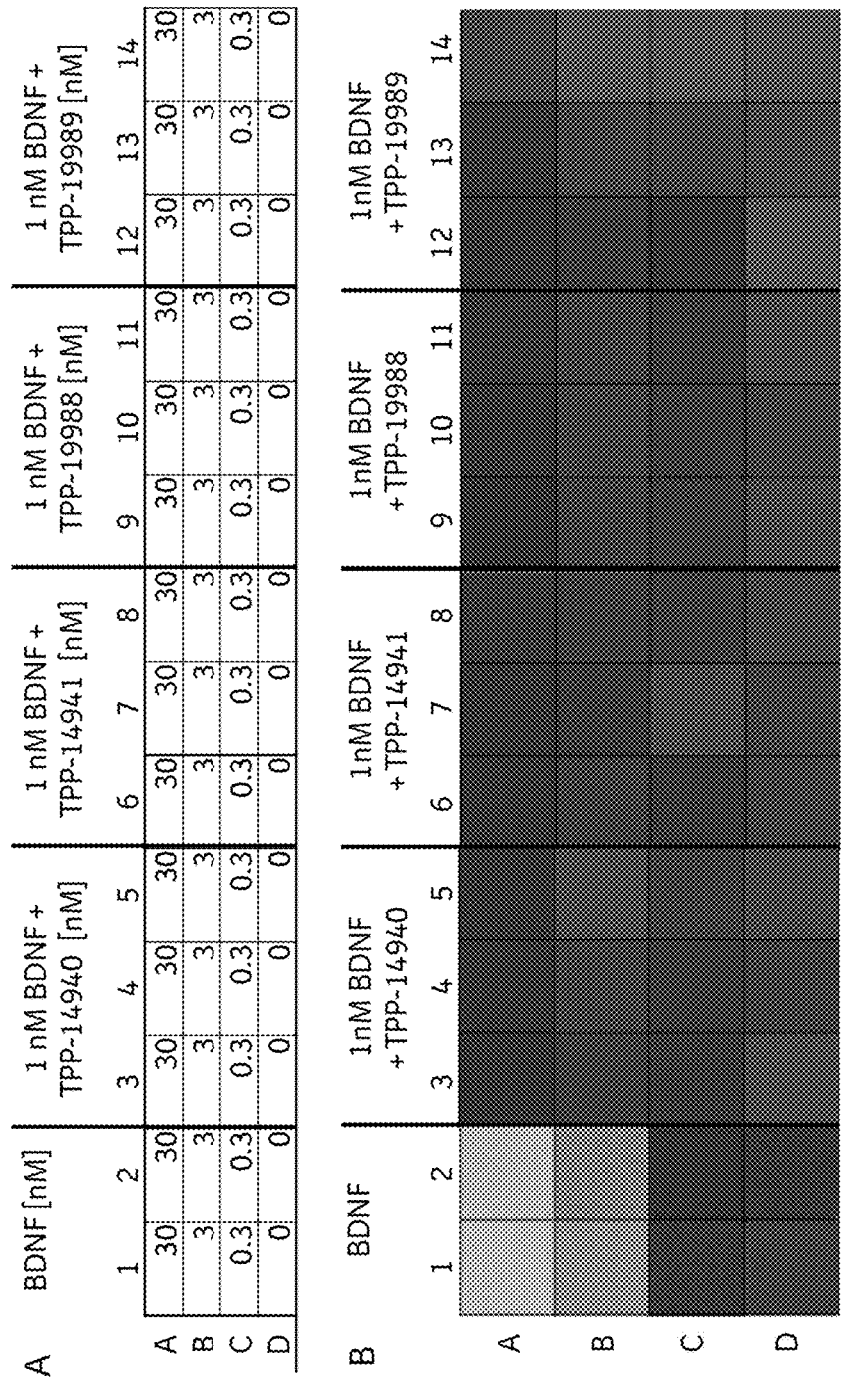
FIG. 41 A-B: (A) CHO cells stably expressing human TrkB were incubated with the indicated concentrations of the natural TrkB ligand BDNF (in duplicate), or 1 nM BDNF with the indicated concentrations of the Doppelmabs (each in triplicate). (B) TrkB internalization was assessed by immunofluorescence staining of surface TrkB receptors followed by confocal microscopy analysis. Dark and light fields of the heatmap represent high and low percentage of cells above fluorescence threshold, respectively.
Figure 42:
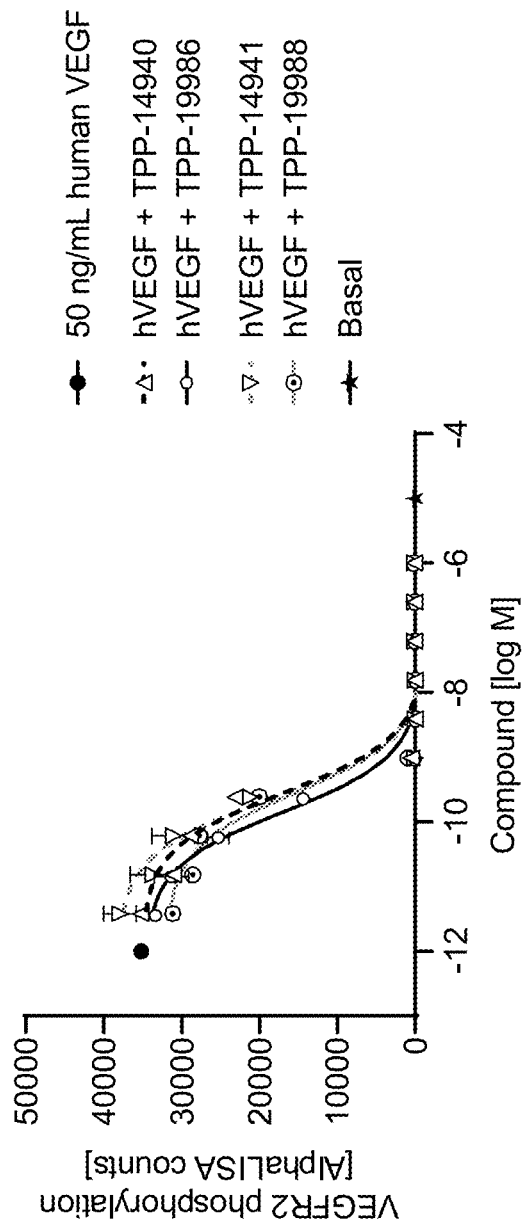
FIG. 42: VEGF-A scavenging was assessed by measuring VEGF receptor 2 phosphorylation (Y1175). For this purpose, human retinal microvascular endothelial cells (HRMECs) were starved and then incubated with 50 ng/mL human VEGF with or without pre-incubation with growing concentrations of the indicated molecules. 50 ng/ml human VEGF without molecule treatment served as control. Data represent mean+/−SEM.
Figure 43:
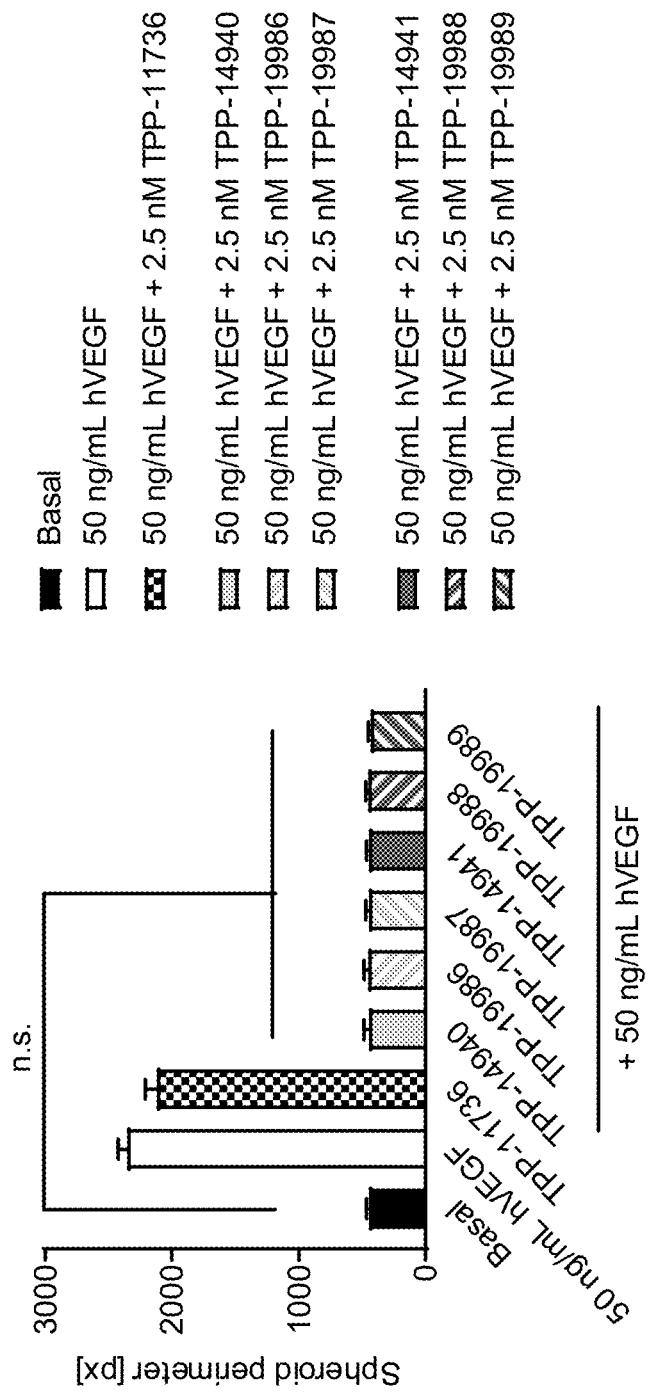
FIG. 43: Endothelial sprouting was assessed by confocal microscopy and displayed spheroid perimeter obtained from maximum projections of Z-stacks. For this purpose, spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of the indicated molecules. Non-stimulated cells served as control (Basal). Data represent mean+/−SEM. n.s. p>0.05 no significant difference; § p<0.0001 compared to 50 ng/mL hVEGF; #p>0.05 no significant difference compared to 50 ng/mL hVEGF. ***p<0.001; one-way Anova with Tukey multi comparison test.
Figure 50:
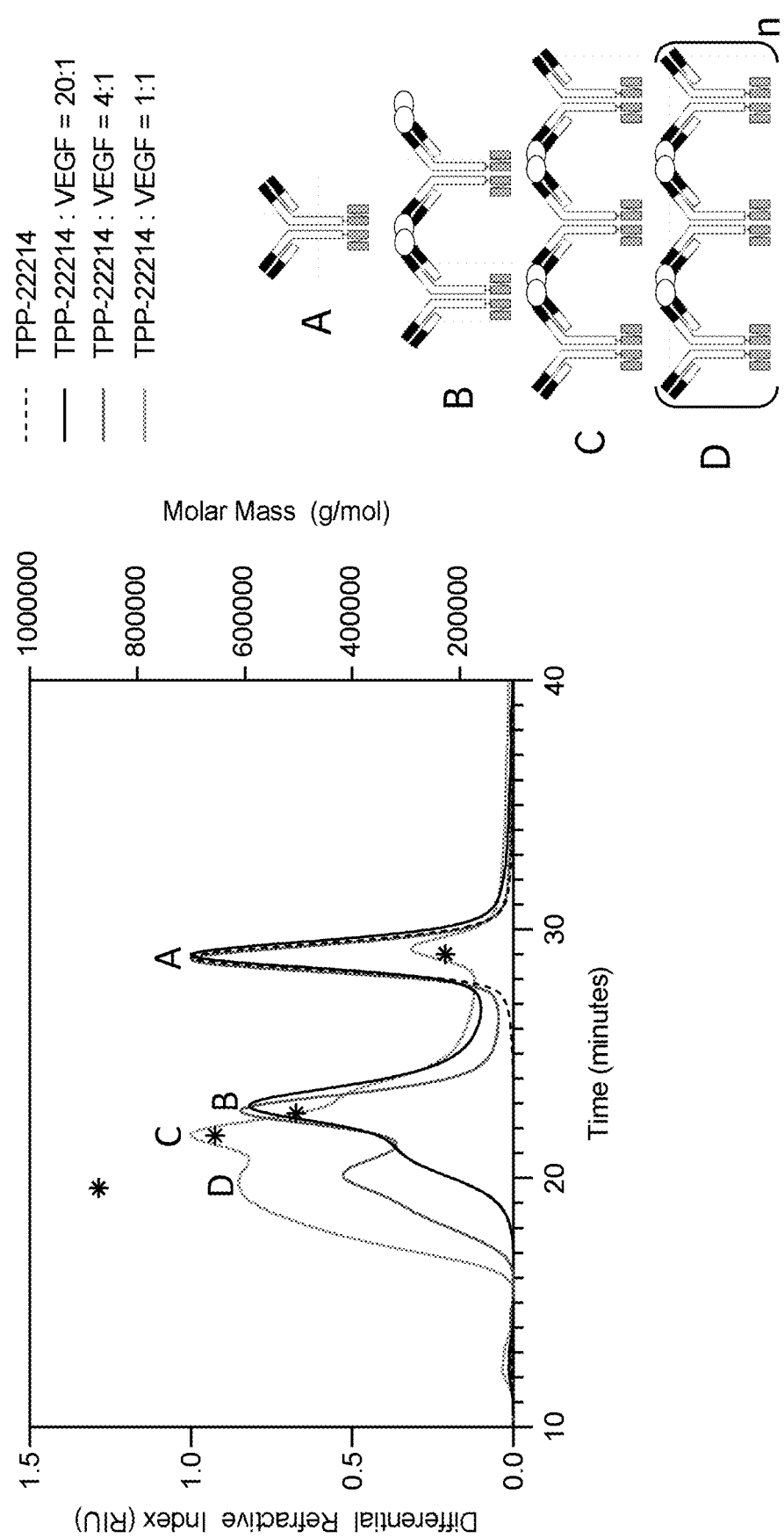
FIG. 50: Size of Dopplemab complex was assessed using size exclusion chromatography combined with a multi-angle light scattering detector. The differential refractive index (black, dark grey, light grey and dashed lines) and light scattering were monitored over the time it takes for the proteins to elute from the size exclusion column. The light scattering data is used to determine the molar mass at each point. The molar mass at the midpoint of each peak is denoted by a star and measured using the right axis. TPP-22214 alone (dashed line) or in complex with VEGF in various ratios was studied (black 20:1, dark grey 4:1, light grey 1:1). A thru D represent possible complex schematics based on the measured molar masses.
Figure 51:
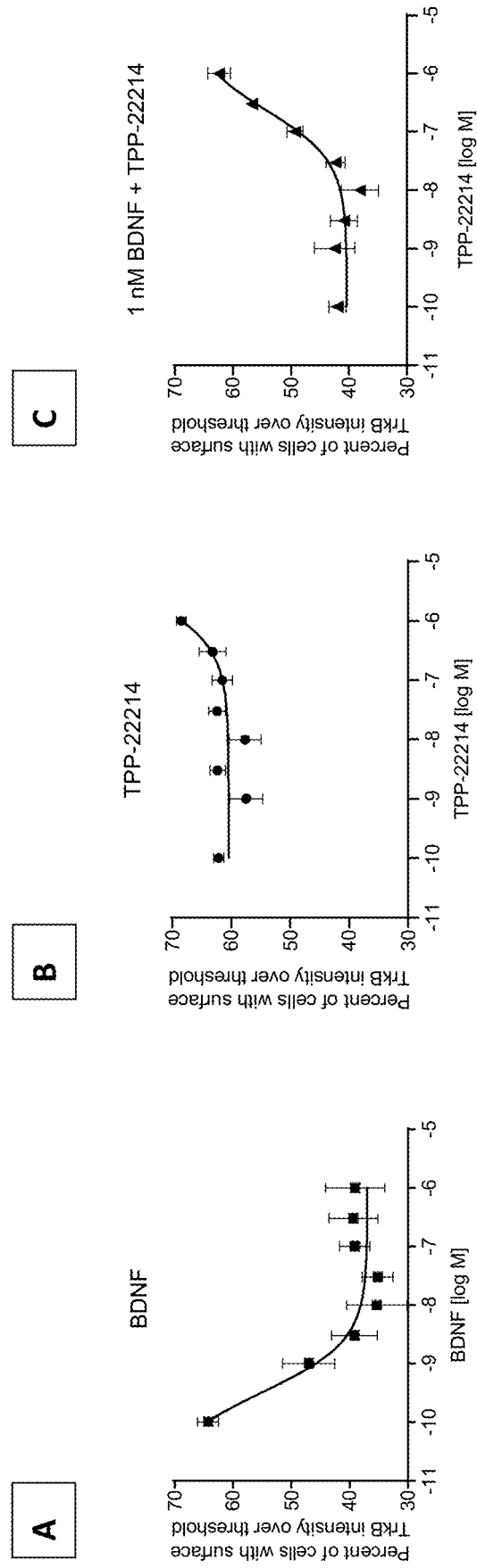
FIG. 51 A-C: TrkB internalization was assessed by immunofluorescence staining the surface TrkB receptors without permeabilization of the cells followed by confocal microscopy analysis. CHO cells with stable expression of human TrkB were incubated with (A) growing concentrations of the natural TrkB ligand BDNF, (B) growing concentrations of TPP-22214 or (C) 1 nM BDNF with growing concentrations of TPP-22214. Data represent the percent of cells with surface TrkB staining intensity above threshold; mean+/−SEM.
Figure 52:
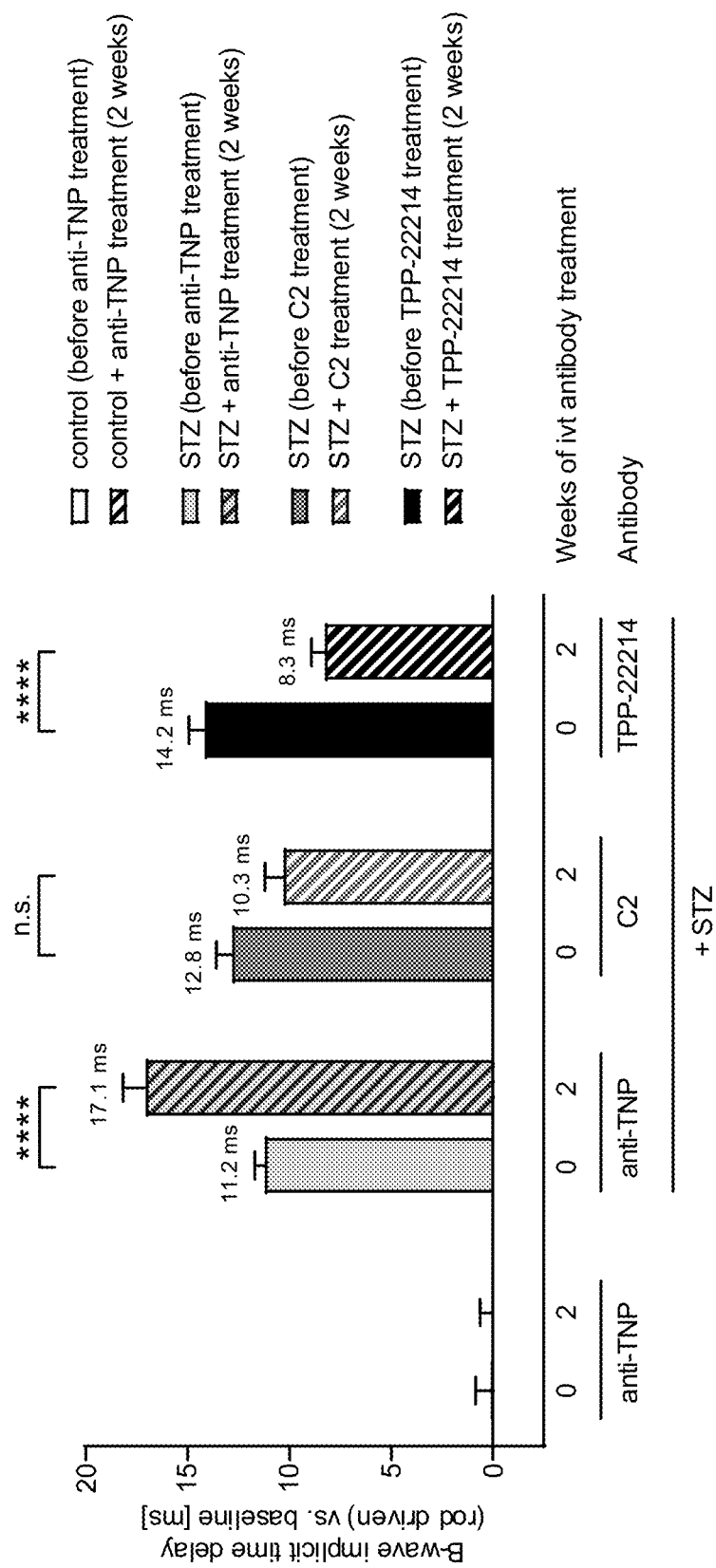
FIG. 52: Neuroprotective function of TrkB activation in a rat model of diabetes-induced retinal neurodegeneration. Animals were treated with STZ to induce hyperglycemia. The retinal function was then assessed by electroretinography (ERG) and rod-driven B-wave implicit time delays immediately before and two weeks after intravitreal application of the agonistic TrkB antibody C2 or Doppelmab TPP-22214; mean+/−SEM; $^{n.s.}$p>0.05; non-significant (n.s.), ****p<0.0001; one-way Anova with Tukey multi-comparison test. Anti-TNP served as isotype control antibody.

In strong contrast to TPP-11736 or the original C2 antibody—both being partial TrkB receptor agonists—all four new Doppelmabs now showed full TrkB receptor agonists activity. TrkB activation by those Doppelmabs was now as efficacious as the natural ligand BDNF. This was totally unexpected since the original C2 antibody only showed partial TrkB receptor agonist. Without wishing to be bound by theory it appears that VEGF induced clustering with the single binding molecules, as well as the sterical formation of the binding molecules, may be responsible for the observed increase in efficacy and potency of TrkB activation (see also FIG. 25).

Potency of TrkB activation was also somewhat better with the Doppelmabs TPP-14938 & TPP-14940 as compared to TPP-14939 & TPP-14941. Thus the "VH-VL" orientation of the C2 scFv showed better potency of TrkB activation.

Example 26

Comparison of Cyno/Rat TrkB Activation by BDNF, TPP-11736 and the Four Doppelmabs TPP-14938, TPP-14939, TPP-14940 and TPP-14941 of the Second Series; TrkB and ERK1/2 Phosphorylation

FIG. 26 A-B

CHO cells with stable expression of (A) cyno TrkB or (B) rat TrkB were incubated with growing concentrations of the natural TrkB ligand BDNF, TPP-11736 (C2 as Fab), or two Doppelmabs TPP-14940 (C2 as scFv, 20L3, VH-VL) and TPP-14941 (C2 as scFv, 20L3, VL-VH) of the second series. TrkB activation was assessed by measuring TrkB phosphorylation on Y706/707. The lowest compound concentration was solvent alone. Data represent mean+/−SEM.

Results:

The results of example 25 with human TrkB could be reproduced in the cyno and rat model. Also here, in strong contrast to TPP-11736, the new Doppelmabs were full TrkB receptor agonists. TrkB activation by those Doppelmabs was as efficacious as the natural ligand BDNF.

Likewise, potency of TrkB activation was somewhat better with the Doppelmab TPP-14940 as compared to TPP-14941. Thus the VH-VL orientation of the C2 scFv showed better potency of TrkB activation.

Example 27

Comparison of Human TrkB Activation (TrkB Phosphorylation) by C2, TPP-14940 and TPP-14941 (Second Series) in the Presence or Absence of Human VEGF—Synergistic Effect

FIG. 27 A-C

CHO cells with stable expression of human TrkB were incubated with growing concentrations of Doppelmabs (A) TPP-14940, (B) TPP-14941, or (C) C2 with or without pre-incubation with 200 ng/mL human VEGF-A (hVEGF). TrkB activation was assessed by measuring TrkB phosphorylation on Y706/707. The lowest compound concentration was solvent alone. Data represent the mean+/−SEM.

Results:

Surprisingly, pre-incubation with human VEGF dramatically improved the potency of TrkB phosphorylation (TrkB activation) by TPP-14941 (C2 as scFv, 20L3, VL-VH).

The impact of VEGF on the potency of TrkB phosphorylation (TrkB activation) was greater for TPP-14941 compared to TPP-14940. Thus, although both molecules showed synergistic effects on potency of TrkB phosphorylation, it appears that the orientation/geometry of the TrkB activating part of the Doppelmabs (scFv VL-VH vs. scFv VH-VL vs. Fab) seems to have an impact on the synergistic effect, with scFv having a VL-VH orientation being preferred.

VEGF pre-incubation did not impact on the potency of TrkB phosphorylation (TrkB activation) by C2 (control).

Example 28

Comparison of Human TrkB Activation (ERK1/2 Phosphorylation) by C2, TPP-14940 and TPP-14941 (Second Series) in the Presence or Absence of Human VEGF—Synergistic Effect

FIG. 28 A-C

CHO cells with stable expression of human TrkB were incubated with growing concentrations of Doppelmabs (A) TPP-14940, (B) TPP-14941, or (C) C2 with or without pre-incubation with 200 ng/mL human VEGF-A (hVEGF). TrkB activation was assessed by measuring ERK1/2 phosphorylation on T202/Y204 (ERK1) and T185/Y187 (ERK2), downstream of TrkB. The lowest compound concentration is solvent alone. Data represent the mean+/−SEM.

Results:

Here as well, surprisingly, pre-incubation with human VEGF dramatically improved the potency of ERK1/2 phosphorylation (TrkB activation) by TPP-14941 (C2 as scFv, 20L3, VL-VH).

Also here, the impact of VEGF on the potency of ERK1/2 phosphorylation (TrkB activation) was greater for TPP-14941 compared to TPP-14940. Again, both molecules showed synergistic effects on potency of TrkB phosphorylation, but it appears that the orientation/geometry of the TrkB activating part of the Doppelmabs (scFv VL-VH vs. scFv VH-VL vs. Fab) seems to have an impact on the synergistic effect with scFv having a VL-VH orientation being preferred.

As shown previously, VEGF pre-incubation did also not impact on the potency of ERK1/2 phosphorylation (TrkB activation) by TPP-11736 (series 1, C2 as Fab). Finally, VEGF pre-incubation did not impact on the potency of ERK1/2 phosphorylation (TrkB activation) by C2 (control).

Example 29

Comparison of Human TrkB Activation (TrkB/ERK Phosphorylation) by VEGF Alone and in Combination with BDNF—Control Experiments for the Synergistic Effect

FIG. 29 A-B

CHO cells with stable expression of human TrkB were incubated with growing concentrations of human VEGF-A (hVEGF) alone or growing concentrations of BDNF, with or without a fixed concentration of 200 ng/mL hVEGF. TrkB activation was assessed by measuring (A) TrkB phosphorylation on Y706/707 or (B) ERK1/2 phosphorylation on T202/Y204 (ERK1) and T185/Y187 (ERK2), downstream of TrkB, respectively. The lowest compound concentration was solvent alone. Data represent the mean+/−SEM.

Results:

hVEGF alone did not induce TrkB or ERK1/2 phosphorylation.

The BDNF dose-response-curve is largely independent of hVEGF.

Example 30

Comparison of Cyno TrkB Activation (TrkB Phosphorylation) by C2, TPP-14940 and TPP-14941 (Second Series) in the Presence or Absence of Human VEGF—Synergistic Effect

FIG. 30 A-C

CHO cells with stable expression of cyno TrkB were incubated with growing concentrations of Doppelmabs (A) TPP-14940, (B) TPP-14941, or (C) C2 with or without pre-incubation with 200 ng/mL human VEGF-A (hVEGF). TrkB activation was assessed by measuring TrkB phosphorylation on Y706/707. The lowest compound concentration was solvent alone. Data represent the mean+/−SEM.

Results:

Also in this model, pre-incubation with human VEGF dramatically improved the potency of TrkB phosphorylation (TrkB activation) by TPP-14941 (C2 as scFv, 20L3, VL-VH). The impact of VEGF on the potency of TrkB phosphorylation (TrkB activation) by TPP-14940 (C2 as scFv, 20L3, HL) was smaller.

Example 31

Comparison of Cyno TrkB Activation (ERK1/2 Phosphorylation) by C2, TPP-14940 and TPP-14941 (Second Series) in the Presence or Absence of Human VEGF—Synergistic Effect

FIG. 31 A-C

CHO cells with stable expression of cyno TrkB were incubated with growing concentrations of Doppelmabs (A) TPP-14940, (B) TPP-14941, or (C) C2 with or without pre-incubation with 200 ng/mL human VEGF-A (hVEGF). TrkB activation was assessed by measuring ERK1/2 phosphorylation on T202/Y204 (ERK1) and T185/Y187 (ERK2), downstream of TrkB. The lowest compound concentration was solvent alone. Data represent the mean+/−SEM.

Results:

Also in this model, pre-incubation with human VEGF dramatically improved the potency of ERK1/2 phosphorylation (TrkB activation) by TPP-14941 (C2 as scFv, 20L3, VL-VH). The impact of VEGF on the potency of ERK1/2 phosphorylation (TrkB activation) by TPP-14940 (C2 as scFv, 20L3, HL) was smaller.

Example 32

Comparison of the Human VEGF-A Scavenging by TPP-11736 (B20 as scFv), TPP-14938 (B20 as Fab) or TPP-14939 (B20 as Fab)—Inhibition of VEGF-Induced Phosphorylation of VEGFR2, ERK1/2 and Src

FIG. 32 A-C

Human retinal microvascular endothelial cells (HRMECs) were starved and then incubated with 50 ng/mL human VEGF with or without pre-incubation with growing concentrations of the Doppelmabs TPP-11736 (B20 as scFv), TPP-14938 (B20 as Fab) or TPP-14939 (B20 as Fab). VEGF-A scavenging was assessed by measuring (A) VEGF receptor 2 (VEGFR2) phosphorylation on Y1175, (B) ERK1/2 phosphorylation on T202/Y204 (ERK1) and T185/Y187 (ERK2), or (C) Src phosphorylation on Y419. 50 ng/ml human VEGF without antibody treatment served as control. Data represent mean+/−SEM. The Table 6 below reports the corresponding best-fit $IC_{50}$ values and the absolute efficacy values (bottom plateaus), respectively (non-linear regression; log(agonist) vs. response (three parameters).

TABLE 6

| | TPP-11736 | TPP-14938 | TPP-14939 |
|---|---|---|---|
| $IC_{50}$ (VEGFR2 phosphorylation) | 2.36 nM | 1.02 nM | 0.742 nM |
| Bottom plateau (VEGFR2 phosphorylation, counts) | 482 | 129 | 242 |
| $IC_{50}$ (ERK½ phosphorylation) | 5.59 nM | 2.71 nM | 2.51 nM |
| Bottom plateau (ERK½ phosphorylation, counts) | 3688 | 1331 | 1144 |
| $IC_{50}$ (Src phosphorylation) | 3.97 nM | 1.80 nM | 1.16 nM |
| Bottom plateau (Src phosphorylation, counts) | 6300 | 5485 | 5538 |

Results:

Potency of VEGF-scavenging ($IC_{50}$) by TPP-14938/39 was somewhat better than TPP-11736.

VEGF scavenging by TPP-14938 and TPP-14939 was more efficacious than TPP-11736 (bottom values are smaller).

Overall the differences between B20 scFv and B20 Fab were rather small and correspond well to the previous results shown in FIG. 17/18: TPP-11736 vs. TPP-13788 (B20 IgG). In conclusion, B20 tolerates reformatting from Fab to scFv apparently relatively well.

Example 33

Comparison of the Human VEGF-A Scavenging by TPP-11736 (B20 scFv), TPP-14938 (B20 Fab) or TPP-14939 (B20 Fab)—Inhibition of VEGF-Induced Proliferation of HRMEC

FIG. 33 A-C

Human retinal microvascular endothelial cells (HRMECs) were starved and then incubated with 10 ng/mL human VEGF with or without pre-incubation with growing concentrations of the indicated binding molecules. Molecule concentrations are given in mol/L. VEGF-A scavenging was assessed by automated, image-based quantification of HRMEC cell numbers (IncuCyte). Images were recorded every four hours for a total period of 84 hours. Relative cell numbers are shown. Cell numbers at t=0 were set to one. Non-stimulated cells served as control (Basal). Data represent mean+/−SEM.

Results:

Reformatting B20 scFv (TPP-11736) into B20 Fab (TPP-14938 & TPP-14939) did neither improve the potency nor the efficacy of VEGF-A-scavenging in the proliferation assay. Indeed, the B20 Fab based antibodies seemed to be somewhat less potent/efficacious than TPP-11736.

Example 34

Comparison of Human VEGF-A Scavenging by TPP-14936 (Ranibizumab, scFv, HL) or TPP-14937 (Ranibizumab, scFv, LH) with TPP-14940 & TPP-14941 (Ranibizumab Fab)—Inhibition of VEGF-Induced Phosphorylation of VEGFR2, ERK1/2 and Src

FIG. 34 A-C

Human retinal microvascular endothelial cells (HRMECs) were starved and then incubated with 50 ng/mL human VEGF with or without pre-incubation with growing concentrations of the Doppelmabs TPP-11736 (B20 as scFv), TPP-14936 (Ranibizumab as scFv, VH-VL), TPP-14937 (Ranibizumab as scFv, VL-VH), TPP-14940 (Ranibizumab as Fab), or TPP-14941 (Ranibizumab as Fab). VEGF-A scavenging was assessed by measuring (A) VEGF receptor 2 (VEGFR2) phosphorylation on Y1175, (B) ERK1/2 phosphorylation on T202/Y204 (ERK1) and T185/Y187 (ERK2), or (C) Src phosphorylation on Y419. 50 ng/ml human VEGF without antibody treatment served as control. Data represent mean+/−SEM. Below Table 7 reports the corresponding best-fit $IC_{50}$ values and the absolute efficacy values (bottom plateaus), respectively (non-linear regression; log(agonist) vs. response (three parameters).

TABLE 7

| | TPP-11736 | TPP-14936 | TPP-14937 | TPP-14940 | TPP-14941 |
|---|---|---|---|---|---|
| $IC_{50}$ (VEGFR2 phosphorylation) | 2.36 nM | 1.90 nM | 4.29 nM | 0.373 nM | 0.292 nM |
| Bottom plateau (VEGFR2 phosphorylation, counts) | 482 | −1097 | −1407 | −567 | −763 |
| $IC_{50}$ (ERK½ phosphorylation) | 5.59 nM | 3.49 nM | 5.58 nM | 0.802 nM | 0.430 nM |
| Bottom plateau (ERK½ phosphorylation, counts) | 3688 | −340 | −926 | 438 | 1147 |

TABLE 7-continued

|  | TPP-11736 | TPP-14936 | TPP-14937 | TPP-14940 | TPP-14941 |
|---|---|---|---|---|---|
| $IC_{50}$ (Src phosphorylation) | 3.97 nM | 3.40 nM | 5.83 nM | 0.276 nM | 0.393 nM |
| Bottom plateau (Src phosphorylation, counts) | 6300 | 4654 | 4571 | 4771 | 4367 |

Results:

Reformatting Ranibizumab from scFv to Fab dramatically improved the potency of VEGF-scavenging in all three assays (10-fold better $IC_{50}$ than Ranibizumab scFv or reference molecule TPP-11736).

Efficacy of VEGF scavenging by the Ranibizumab-based molecules was a lot better than TPP-11736 (bottom values).

However, Ranibizumab did not tolerate reformatting from Fab to scFv very well (in contrast to B20, see earlier examples).

Example 35

Comparison of Human VEGF-A Scavenging by TPP-14936 (Ranibizumab as scFv, VH-VL) or TPP-14937 (Ranibizumab as scFv, VL-VH) with TPP-14940 & TPP-14941 (Ranibizumab Fab)—Inhibition of VEGF-Induced Proliferation of HRMEC

FIG. 35 A-D

Human retinal microvascular endothelial cells (HRMECs) were starved and then incubated with 10 ng/mL human VEGF with or without pre-incubation with growing concentrations of the indicated binding molecules. Molecule concentrations are given in mol/L. VEGF-A scavenging was assessed by automated, image-based quantification of HRMEC cell numbers (IncuCyte). Images were recorded every four hours for a total period of 84 hours. Relative cell numbers are shown. Cell numbers at t=0 were set to one. Non-stimulated cells served as control (Basal). Data represent mean+/−SEM.

Results:

Reformatting Ranibizumab as scFv (TPP-11736/TPP-14937) into Ranibizumab Fab (TPP-14940 & TPP-14941) significantly improved the potency of VEGF-A-scavenging in the proliferation assay.

With TPP-14940 & TPP-14941, full VEGF-inhibition was already seen at a concentration of 0.25 nM, whereas 1 nM TPP-14936 and 4 nM TPP-14937 were needed for full inhibition, respectively.

The efficacy of VEGF-A-inhibition was similar among all four molecules (all full inhibitors).

Example 36

Comparison of Human VEGF-A Scavenging by TPP-14938 or TPP-14939 (B20 Fab) with TPP-14940 & TPP-14941 (Ranibizumab Fab)—Inhibition of VEGF-Induced Phosphorylation of VEGFR2, ERK1/2 and Src

FIG. 36 A-C

Human retinal microvascular endothelial cells (HRMECs) were starved and then incubated with 50 ng/mL human VEGF with or without pre-incubation with growing concentrations of the Doppelmabs TPP-11736 (B20 as scFv), TPP-13938 (B20 as Fab) or TPP-13939 (B20 as Fab), TPP-14940 (Ranibizumab as Fab), or TPP-14941 (Ranibizumab as Fab). VEGF-A scavenging was assessed by measuring (A) VEGF receptor 2 (VEGFR2) phosphorylation on Y1175, (B) ERK1/2 phosphorylation on T202/Y204 (ERK1) and T185/Y187 (ERK2), or (C) Src phosphorylation on Y419. 50 ng/ml human VEGF without molecule treatment served as control. Data represent mean+/−SEM. Below Table 8 reports the corresponding best-fit $IC_{50}$ values and the absolute efficacy values (bottom plateaus), respectively (non-linear regression; log(agonist) vs. response (three parameters).

TABLE 8

|  | TPP-11736 | TPP-14938 | TPP-14939 | TPP-14940 | TPP-14941 |
|---|---|---|---|---|---|
| $IC_{50}$ (VEGFR2 phosphorylation) | 2.36 nM | 1.02 nM | 0.742 nM | 0.373 nM | 2.92 nM |
| Bottom plateau (VEGFR2 phosphorylation, counts) | 482 | 129 | 242 | −567 | −763 |
| $IC_{50}$ (ERK½ phosphorylation) | 5.59 nM | 2.71 nM | 2.51 nM | 0.802 nM | 0.430 nM |
| Bottom plateau (ERK½ phosphorylation, counts) | 3688 | 1331 | 1144 | 438 | 1147 |
| $IC_{50}$ (Src phosphorylation) | 3.97 nM | 1.80 nM | 1.16 nM | 0.276 nM | 0.393 nM |
| Bottom plateau (Src phosphorylation, counts) | 6300 | 5485 | 5538 | 4771 | 4367 |

Results:

Doppelmabs with Ranibizumab Fab showed clearly better potency of VEGF-scavenging than Doppelmabs based on B20 Fab in all three assays.

Doppelmabs with Ranobizumab Fab showed clearly better efficacy of VEGF-scavenging than Doppelmabs based on B20 Fab in all three assays (bottom values).

Example 37

Comparison of Human VEGF-A Scavenging by TPP-14938 or TPP-14939 (B20 as Fab) with TPP-14940 & TPP-14941 (Ranibizumab as Fab)—Inhibition of VEGF-Induced Proliferation of HRMEC

FIG. 37 A-D

Human retinal microvascular endothelial cells (HRMECs) were starved and then incubated with 10 ng/mL human VEGF with or without pre-incubation with growing concentrations of the indicated binding molecules. Molecule concentrations are given in mol/L. VEGF-A scavenging was assessed by automated, image-based quantification of HRMEC cell numbers (IncuCyte). Images were recorded every four hours for a total period of 84 hours. Relative cell numbers are shown. Cell numbers at t=0 were set to one. Non-stimulated cells served as control (Basal). Data represent mean+/−SEM.

Results:

Potency and efficacy of inhibition of VEGF-induced proliferation by the Ranibizumab Fab-based molecules TPP-14940 & TPP-14941 was clearly superior compared to the B20 Fab-based molecules TPP-14938 & TPP-14939.

Even at the highest concentration (16 nM), TPP-14938 & TPP-14941 failed to fully inhibit VEGF-induced sprouting.

In contrast, TPP-14940 & TPP-14941 fully inhibited VEGF-induced proliferation already at a 64-fold lower concentration of 0.25 nM.

Example 38

Comparison of Human VEGF-A Scavenging by Doppelmabs TPP-11736 (B20 as scFv), TPP-14936 (Ranibizumab as scFv, VH-VL), TPP-14937 (Ranibizumab as scFv, VL-VH), TPP-14938 (B20 as Fab) or TPP-14939 (B20 Fab), TPP-14940 (Ranibizumab as Fab), TPP-14941 (Ranibizumab as Fab) or EYLEA® (Aflibercept)—Inhibition of VEGF-Induced HRMEC Sprouting

FIG. 38

Spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of Doppelmab TPP-11736 (B20 scFv), TPP-14936 (Ranibizumab scFv, VH-VL), TPP-14937 (Ranibizumab scFv, VL-VH), TPP-14938 (B20 Fab), TPP-14939 (B20 Fab), TPP-14940 (Ranibizumab Fab), TPP-14941 (Ranibizumab Fab) or 5 nM EYLEA® (aflibercept). Endothelial sprouting was assessed by confocal microscopy and displayed spheroid perimeter obtained from maximum projections of Z-stacks. Non-stimulated cells served as control (Basal). Data represent mean+/−SEM. n.s. $p>0.05$ no significant difference; § $p<0.0001$ compared to 50 ng/mL hVEGF; #$p>0.05$ no significant difference compared to 50 ng/mL hVEGF. ***$p<0.001$; one-way Anova with Tukey multi comparison test.

Results:

The Ranibizumab Fab based Doppelmabs TPP-14940 & TPP-14941 were clearly the best VEGF-scavengers in this assay. In contrast to EYLEA® (aflibercept), TPP-14940 & TPP-14941 fully inhibited VEGF-induced sprouting; no statistically significant difference was seen between the endothelial sprouting in the absence of VEGF (Basal) and 50 ng/mL hVEGF pre-incubated with 2.5 nM TPP-14940 or TPP-14941.

Inhibition of VEGF-induced EC sprouting by TPP-14940 & TPP-14941 was significantly better than inhibition by any other Doppelmab.

Inhibition of VEGF-induced EC sprouting by TPP-14940 & TPP-14941 was significantly better than inhibition by EYLEA® (aflibercept).

Furthermore, there was no statistically significant difference between the endothelial sprouting stimulated with 50 ng/mL hVEGF and 50 ng/mL hVEGF pre-incubated with EYLEA® (aflibercept).

Example 39

Comparison of Human VEGF-A Scavenging by Doppelmab TPP-11940 and EYLEA® (Aflibercept)—Inhibition of Human VEGF-A-Induced Retinal Hyperpermeability in Brown Norway Rats

FIG. 39 A-B

TPP-14940 (but not EYLEA® (aflibercept)) prevented human VEGF-A-induced hyperpermeability in the rat retina. (A) Time protocol showing the experimental procedure. Fifteen minutes after intravitreal (ivt) administration of the anti-VEGF compound (13 or 26 pmol per eye of EYLEA® (aflibercept) or TPP-14940) or the control (26 pmol TPP-11737), 13 pmol human VEGF-A per eye was administered by ivt injection. PBS injection served as control. Twenty-four hours later 1 mL/kg of an Evans Blue (EB) solution (45 mg/mL in 0.9% saline) were administered by intravenous (iv) injection for 30 minutes before the eyes were isolated and fixed. Plasma samples were collected at the same point in time to confirm equal systemic EB exposure. (B) Quantification of VEGF-A-induced hyperpermeability in the retinas of Brown Norway rats was done by measuring EB extravasation in retinal flatmounts by confocal microscopy. Eyes were cut along the Ora serrata, lens and vitreous were removed and the eye cup was fixed in paraformaldehyde (4%) for 1 h at 4° C. and then transferred to PBS overnight at 4° C. The retinae were separated from the outer segments (sclera and choroidea) and transferred to a glass slide and cut four times to achieve a flat cloverleaf-like structure. The tissue was covered with mounting medium (Vectashield® antifade mounting medium H-1200 containing the DNA stain DAPI) and a coverslip was put on top to obtain a retinal flatmount. The samples were excited at a wavelength of 639 nm and emission of Evans Blue at 669 nm was recorded with a LSM 700 confocal laser scanning-microscope (Carl Zeiss, Jena; gain 800, laser strength 2%, 5 stacks of 60 μm) and images of the retinal flatmounts with maximum intensity projection were obtained. Analysis of fluorescence intensity sum was done after opening the images in the program ImageJ with a threshold of 30. ***$p<0.001$; *$p<0.05$; n.s. $p>0.05$; #$p>0.05$ non-significant vs. TPP-11737+PBS. One-way Anova with Tukey multi comparison test, n=9-17.

Results:

Under control conditions, intravitreal VEGF-A injection increased the vascular permeability by about 60%. TPP-11737 was used as control antibody because it has the same molecular format (Doppelmab) as TPP-14940 but in earlier in vitro assays the compound did not scavenge VEGF.

At a 1:1 and a 2:1 molecular ratio of binding molecule vs VEGF, TPP-14940 completely blocked vascular hyperpermeability. In sharp contrast, however, EYLEA® (aflibercept) failed to significantly reduce vascular leakage under the same conditions and even at the doubled concentration.

Summary of Findings Series 2—TPP-14938, TPP-14939, TPP-14940, TPP-14941

TrkB Activation:

In strong contrast to TPP-11736, all four new Doppelmabs were full TrkB receptor agonists. TrkB activation by those Doppelmabs was as efficacious as the natural ligand BDNF.

Potency of TrkB activation was somewhat better in Doppelmabs with "VH-VL" orientation TPP-14938/40 vs. TPP-14939 & TPP-14941.

Surprisingly, pre-incubation with human VEGF dramatically improved the potency of TrkB phosphorylation (TrkB activation) by TPP-14941 [C2, scFv, 20L3, VL-VH] pointing to a synergistic effect.

In contrast to TPP-14941, the impact of VEGF on the potency of TrkB phosphorylation (TrkB activation) by TPP-14940 [C2, scFv, 20L3, VH-VL] was comparatively smaller.

VEGF-Scavenging:

Reformatting B20 scFv (TPP-11736) into B20 Fab (TPP-14938 & TPP-14939) did neither improve the potency nor the efficacy of VEGF-A-scavenging in the proliferation assay.

Reformatting Ranibizumab scFv (TPP-11736/TPP-14937) into Ranibizumab Fab (TPP-14940 & TPP-14941) significantly improved the potency of VEGF-A-scavenging in the proliferation assay.

Full VEGF-inhibition was already seen at a concentration as low as 0.25 nM with TPP-14940 & TPP-14941.

Potency and efficacy of inhibition of VEGF-induced proliferation by the Ranibizumab Fab-based molecules TPP-14940 & TPP-14941 was superior compared to the B20 Fab-based molecules TPP-14938 & TPP-14939.

Since the inventors observed linker clipping in the binding molecules (data not shown) in the following examples further molecules were derived on the basis of TPP-14940: TPP-19986 (VH-VL, 10L1), TPP-19987 (VH-VL, 20L1); and on the basis of TPP-14941: TPP-19988 (VL-VH, 10L1), TPP-19989 (VL-VH, 20L1), which were all based on Ranibizumab as Fab and C2 as scFv.

Example 40

Comparison of Human TrkB Activation by BDNF, TPP-14940 [C2, scFv, 20L3, VH-VL] or its Linker Variants TPP-19986 [C2, scFv, 10L1, VH-VL] or TPP-19987 [C2, scFv, 20L1, VH-VL], or TPP-14941 [C2, scFv, 20L3, VL-VH] and its Linker Variants TPP-19988 [C2, scFv, 10L1, VL-VH] or TPP-19989 [C2, scFv, 20L1, VL-VH]; TrkB and ERK1/2 Phosphorylation—Series 3

FIG. 40 A-D

CHO cells with stable expression of human TrkB were incubated with growing concentrations of the natural TrkB ligand BDNF, TPP-14940 [C2, scFv, 20L3, VH-VL] or its linker variants TPP-19986 [C2, scFv, 10L1, VH-VL] or TPP-19987 [C2, scFv, 20L1, VH-VL], or TPP-14941 [C2, scFv, 20L3, V-VH] and its linker variants TPP-19988 [C2, scFv, 10L1, VL-VH] or TPP-19989 [C2, scFv, 20L1, VL-VH]. TrkB activation was assessed by (A & B) measuring TrkB phosphorylation on Y706/707 or by (C & D) measuring ERK1/2 phosphorylation on T202/Y204 (ERK1) and T185/Y187 (ERK2), respectively. The lowest compound concentration was solvent alone. Data represent mean+/− SEM. The Tables 9 and 10 below report the corresponding best-fit $EC_{50}$ values of TrkB and ERK1/2 phosphorylation, respectively (non-linear regression; log(agonist) vs. response (three parameters).

TABLE 9

| | BDNF | TPP-14940 | TPP-19986 | TPP-19987 |
|---|---|---|---|---|
| $EC_{50}$ (pTrkB) | 1.22 nM | 3.21 nM | 2.00 nM | 2.16 nM |
| $EC_{50}$ (pERK) | 0.507 nM | 0.475 nM | 0.406 nM | 0.381 nM |

TABLE 10

| | BDNF | TPP-14941 | TPP-19988 | TPP-19989 |
|---|---|---|---|---|
| $EC_{50}$ (pTrkB) | 1.28 nM | 6.28 nM | 7.83 nM | 7.37 nM |
| $EC_{50}$ (pERK) | 0.282 nM | 1.29 nM | 2.05 nM | 1.77 nM |

Results:

There was no significant difference between the parental molecules and the respective linker variants. Potency and efficacy of TrkB and ERK1/2 phosphorylation were virtually identical. This was noteworthy because the linkers were located close to the TrkB binding site but yet did not impact the biological activity of the binding molecule.

All tested molecules were full TrkB agonists.

Again, as shown earlier, potency of TrkB/ERK phosphorylation was better for TPP-14940 molecule and its linker variants (VH-VL orientation) compared to the TPP-14941 molecule and its linker variants (VL-VH orientation).

Example 41

Comparison of Human TrkB Internalization by BDNF, TPP-14940 [C2, scFv, 20L3, VH-VL] or TPP-14941 [C2, scFv, 20L3, VL-VH] and the Linker Variants TPP-19988 [C2, scFv, 10L1, VL-VH] or TPP-19989 [C2, scFv, 20L1, VL-VH]—Series 3

FIG. 41 A-B

CHO cells with stable expression of cyno TrkB were incubated with growing concentrations of the natural TrkB ligand BDNF, or 1 nM BDNF with growing concentrations of the Doppelmabs of the first series TPP-14940 [C2, scFv, 20L3, VH-VL] or TPP-14941 [C2, scFv, 20L3, VL-VH] and the linker variants TPP-19988 [C2, scFv, 10L1, VL-VH] or TPP-19989 [C2, scFv, 20L1, VL-VH]. TrkB internalization was assessed by immunofluorescence staining the surface TrkB receptors without permeabilization of the cells followed by confocal microscopy analysis. Dark and light fields of the heatmap represent high and low percentage of cells above florescence threshold, respectively.

Results:

BDNF induced TrkB receptor internalization. Although TPP-14940, TPP-14941, TPP-19988 and TPP-19989 were full TrkB receptor agonists, none of the Doppelmabs increased the BDNF-induced receptor internalization but rather decreased the BDNF-induced internalization of the TrkB receptor (note: heatmap fields are getting darker from bottom to top).

Example 42

Comparison of Human VEGF-A Scavenging by TPP-14940 and its Linker Variant TPP-19986, and TPP-14941 and its Linker Variant TPP-19988—Inhibition of VEGF-Induced Phosphorylation of VEGFR2—Series 3

FIG. 42

Human retinal microvascular endothelial cells (HRMECs) were starved and then incubated with 50 ng/mL human VEGF with or without pre-incubation with growing concentrations of the Doppelmabs TPP-14940 and its linker variant TPP-19986, and TPP-14941 and its linker variant TPP-19988. VEGF-A scavenging was assessed by measuring VEGF receptor 2 (VEGFR2) phosphorylation on Y1175. 50 ng/ml human VEGF without molecule treatment served as control. Data represent mean+/−SEM. The Table 11 below reports the corresponding best-fit $IC_{50}$ values of the inhibition of VEGFR2 phosphorylation (non-linear regression; log(agonist) vs. response (three parameters).

TABLE 11

|  | TPP-14940 | TPP-19986 | TPP-19987 | TPP-14941 | TPP-19988 | TPP-19989 |
|---|---|---|---|---|---|---|
| $IC_{50}$ (VEGFR2 phosphorylation) | 0.280 nM | 0.142 nM | 0.188 nM | 0.225 nM | 0.281 nM | 0.268 nM |

Results:

There was no significant difference between the parental molecules TPP-14940/TPP-14941 and the respective linker variants. Potency and efficacy of inhibition of VEGF-induced VEGFR2 phosphorylation was virtually identical.

Example 43

Comparison of Human VEGF-A Scavenging by Doppelmabs TPP-14940 [C2, scFv, 20L3, VH-VL] or its Linker Variants TPP-19986 [C2, scFv, 10L1, VH-VL] or TPP-19987 [C2, scFv, 20L1, VH-VL], or TPP-14941 [C2, scFv, 20L3, VL-VH] and its Linker Variants TPP-19988 [C2, scFv, 10L1, VL-VH] or TPP-19989 [C2, scFv, 20L1, VL-VH]—Inhibition of VEGF-Induced HRMEC Sprouting—Series 3

FIG. 43

Spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of Doppelmabs TPP-11736 (B20 scFv), TPP-14940 [C2, scFv, 20L3, VH-VL] or its linker variants TPP-19986 [C2, scFv, 10L1, VH-VL] or TPP-19987 [C2, scFv, 20L1, VH-VL], or TPP-14941 [C2, scFv, 20L3, VL-VH] and its linker variants TPP-19988 [C2, scFv, 10L1, VL-VH] or TPP-19989 [C2, scFv, 20L1, VL-VH]. Endothelial sprouting was assessed by confocal microscopy and displayed spheroid perimeter obtained from maximum projections of Z-stacks. Non-stimulated cells served as control (Basal). Data represent mean+/−SEM. n.s. p>0.05 no significant difference; § p<0.0001 compared to 50 ng/mL hVEGF; #p>0.05 no significant difference compared to 50 ng/mL hVEGF. ***p<0.001; one-way Anova with Tukey multi comparison test.

Results:

No significant difference was observed between the parental molecules TPP-14940/TPP-14941 and the respective linker variants. All molecules fully inhibited VEGF-induced sprouting of the HRMEC.

Summary of Findings Series 3—TPP-19986, 19987, 19988, 19989

TrkB Activation:

No significant differences were observed between the parental molecules (TPP-14940/14941) and the respective linker variants.

All tested binding molecules were full TrkB receptor agonists. VH-VL orientation and its linker variants were still more potent.

No change in receptor internalization was observed. This was very surprising considering that the new Doppelmabs were, similar to BDNF, full TrkB receptor agonists.

VEGF-Scavenging:

No significant differences were observed between the parental molecules (TPP-14940/14941) and the respective linker variants.

CMC Properties:

Linker clipping was no longer observed with the use of the linkers 10L1 & 20L1 linker (data not shown).

As next steps, a final series of binding molecules were designed (Series 4) to improve CMC as well as Biophysics properties of the binding molecules but always trying to preserve the superior biological function of the binding molecules of the invention.

Example 44

Comparison of Human TrkB Activation by Doppelmabs without or with disulfide Bridge (CC) in the TrkB scFv Portion; TrkB Phosphorylation—Series 4

FIG. 44 A-D

CHO cells with stable expression of human TrkB were incubated with growing concentrations of the indicated Doppelmabs with/without CC bridge in the anti-TrkB scFv portion. (A) TPP-22180 vs. TPP-22204; (B) TPP-22192 vs. TPP-22216; (C) TPP-22190 vs. TPP-22214; (D) TPP-22191 vs. TPP-22215. TrkB activation was assessed by measuring TrkB phosphorylation on Y706/707. The lowest compound concentration was solvent alone. Data represent mean+/−SEM. The Table 12 below reports the corresponding best-fit $EC_{50}$ values, and the absolute or relative efficacy values (top plateaus) of TrkB activation, respectively (non-linear regression; log(agonist) vs. response (three parameters).

TABLE 12

| TPP | FIG. | Description | TrkB-phosphorylation potency ($EC_{50}$, nM) | TrkB-phosphorylation efficacy (AlphaLISA counts) | TrkB-phosphorylation efficacy relative to parental clone without CC bridge (%) |
|---|---|---|---|---|---|
| TPP-22180 | A | (1Q6Q70G_TrkB-C2-VH-VL_10L1) | 8.09 | 6642 | 100 |

TABLE 12-continued

| TPP | FIG. | Description | TrkB-phosphorylation potency ($EC_{50}$, nM) | TrkB-phosphorylation efficacy (AlphaLISA counts) | TrkB-phosphorylation efficacy relative to parental clone without CC bridge (%) |
|---|---|---|---|---|---|
| TPP-22204 | A | (1Q6Q70G_TrkB-C2-VH-VL_10L1, CC) | 3.88 | 7613 | 115 |
| TPP-22192 | B | (1Q6Q70G_TrkB-C2-VL-VH_10L1) | 12.2 | 5642 | 100 |
| TPP-22216 | B | (1Q6Q70G_TrkB-C2-VL-VH_10L1, CC) | 4.33 | 8407 | 149 |
| TPP-22190 | C | (1Q70G_TrkB-C2-VL-VH_10L1) | 9.95 | 4225 | 100 |
| TPP-22214 | C | (1Q70G_TrkB-C2-VL-VH_10L1, CC) | 2.18 | 5102 | 121 |
| TPP-22191 | D | (6Q70G_TrkB-C2-VL-VH_10L1) | 5.49 | 4848 | 100 |
| TPP-22215 | D | (6Q70G_TrkB-C2-VL-VH_10L1, CC) | 1.12 | 5793 | 119 |

Results:

The disulfide bridge was introduced mainly to improve the CMC properties of the binding molecules. Surprisingly, by including the disulfide bridge in the scFv anti-TrkB part further improved both potency and efficacy of TrkB activation. A greater impact was observed in the binding molecule having the VL-VH orientation.

Example 45

Comparison of Rat TrkB Activation by Doppelmabs with or without Disulfide Bridge (CC) in the TrkB scFv Portion; TrkB Phosphorylation—Series 4

FIG. 45 A-B

CHO cells with stable expression of rat TrkB were incubated with growing concentrations of the indicated Doppelmabs with/without CC bridge in the anti-TrkB scFv portion. (A) TPP-22180 vs. TPP-22204; (B) TPP-22192 vs. TPP-22216. TrkB activation was assessed by measuring TrkB phosphorylation on Y706/707. The lowest compound concentration was solvent alone. Data represent mean+/−SEM. The Table 13 below reports the corresponding best-fit $EC_{50}$ values and the absolute or relative efficacy values (top plateaus) of TrkB activation, respectively (non-linear regression; log (agonist) vs. response (three parameters).

Results:

Including the disulfide bridge in the scFv anti-TrkB part improved both potency and efficacy of TrkB activation. Again, the impact on VL-VH orientated binding molecules appeared to be larger. Overall, the data was in good agreement with the data obtained for human TrkB.

Example 46

Selectivity of TPP-22204/22214-Mediated TrkB Activation

FIG. 46

CHO cells with stable expression of (A) human TrkA, (B) human TrkB, or (C) human TrkC were incubated with growing concentrations of the C2 antibody or the Doppelmabs TPP-22204 or TPP-22214. Activation of the Trk receptors was assessed by measuring receptor phosphorylation on Y706/707. Incubation with growing concentrations of the natural ligands for TrkA (NGF), TrkB (BDNF) and TrkC (NT-3) were used as controls. The lowest compound concentration was solvent alone. Data represent the mean+/−SEM.

Results:

Both Doppelmabs were very specific/selective for TrkB—None of them activated either TrkA or TrkC.

TABLE 13

| TPP | FIG. | Description | TrkB-phosphorylation potency ($EC_{50}$, nM) | TrkB-phosphorylation efficacy (AlphaLISA counts) | TrkB-phosphorylation efficacy relative to parental clone without CC bridge (%) |
|---|---|---|---|---|---|
| TPP-22180 | A | (1Q6Q70G_TrkB-C2-VH-VL_10L1) | 4.21 | 19676 | 100 |
| TPP-22204 | A | (1Q6Q70G_TrkB-C2-VH-VL_10L1, CC) | 2.01 | 21787 | 111 |
| TPP-22192 | B | (1Q6Q70G_TrkB-C2-VL-VH_10L1) | 18.9 | 21213 | 100 |
| TPP-22216 | B | (1Q6Q70G_TrkB-C2-VL-VH_10L1, CC) | 3.31 | 25808 | 122 |

Example 47

Impact of TPP-22214 on BDNF-Induced TrkB Activation

FIG. 47 A-B

CHO cells with stable expression of human TrkB receptor were incubated with growing concentrations of (A) C2 antibody or (B) Doppelmab TPP-22214 with or without a constant concentration of 0.3 nM, 1 nM or 3 nM BDNF. Activation of TrkB was assessed by measuring receptor phosphorylation on Y706/707. Data represent the mean+/−SEM.

Results:

In strong contrast to C2, TPP-22214 did not limit BDNF-induced TrkB activation.

Example 48

Comparison of Human TrkB Activation (TrkB Phosphorylation) by TPP-22214 in the Presence or Absence of Human VEGF

FIG. 48 A-D

CHO cells with stable expression of human TrkB were incubated with growing concentrations of Doppelmab TPP-22214 with or without pre-incubation with (A) 200 ng/mL human VEGF-A (hVEGF), (B) 50 ng/mL hVEGF, (C) 10 ng/mL hVEGF, or (D) 2 ng/mL hVEGF. TrkB activation was assessed by measuring TrkB phosphorylation on Y706/707. The lowest compound concentration was solvent alone. Data represent the mean+/−SEM.

Results:

As shown before, pre-incubation with 200 ng/mL human VEGF improved potency of TrkB phosphorylation (TrkB activation) by TPP-22214. More importantly, this synergistic effect was largely retained at 50, 10 and even 2 ng/mL hVEGF. Similar effects were also obtained in other species such as cyno (data not shown).

Example 49

Comparison of Human TrkB Activation (ERK Phosphorylation) by TPP-22214 in the Presence or Absence of Human VEGF

FIG. 49 A-D

CHO cells with stable expression of human TrkB were incubated with growing concentrations of Doppelmab TPP-22214 with or without pre-incubation with 200 ng/mL (A) human VEGF-A (hVEGF), (B) 50 ng/mL hVEGF, (C) 10 ng/mL hVEGF, or (D) 2 ng/mL hVEGF. TrkB activation was assessed by measuring ERK1/2 phosphorylation on T202/Y204 (ERK1) and T185/Y187 (ERK2), downstream of TrkB. The lowest compound concentration was solvent alone. Data represent the mean+/−SEM.

Results:

Likewise, pre-incubation with 200 ng/mL human VEGF improved also the potency of ERK phosphorylation downstream of TrkB activation by TPP-22214. Also in this assay, the synergistic effect was largely retained at concentrations as low as 2 ng/mL hVEGF. Similar effects were also obtained in other species such as cyno (data not shown).

Example 50

VEGF Binding Potentiates TrkB Activation—Studying Proposed Mechanism

FIG. 50

Complex of TPP-22214 and hVEGF was made by mixing together the samples at the described molar ratio (1:1, 4:1 or 20:1) in 1× Dulbecco's PBS. Samples were incubated for 1 hour at room temperature prior to analysis. An Agilent 1200 was used in series with miniDAWN® TREOS® compact SEC-MALs detector and Optilab® T-REX detector (Wyatt Technologies Corp.). The samples were run in 1× Dulbecco's PBS as the mobile phase at a flow rate of 0.6 ml/min. 100 µl of the complex or TPP-22214 alone was injected on a Superose 6 Increase column (30 cm×10 mm), where molecules were subjected to separation by hydrodynamic volume. The data were then analyzed using ASTRA® software version 6.1.1.17 Wyatt Technologies Corp.).

Results:

TPP-22214 forms complexes in the presence of VEGF-A with largest complexes formed at 1:1 molar ratio. These complexes suggest complexing of the Doppelmab and VEGF beyond 1:1 ratio. These larger complexes can lead to clustering of the TrkB receptors on the cell surface. Experimental data support the proposed mechanism.

Example 51

Comparison of Human TrkB Internalization by Growing Concentrations of BDNF or TPP-22214, and Growing Concentrations of TPP-22214 in the Presence of 1 nM BDNF

FIG. 51 A-C

CHO cells with stable expression of human TrkB were incubated with (A) growing concentrations of the natural TrkB ligand BDNF, (B) growing concentrations of TPP-22214, or (C) 1 nM BDNF with growing concentrations of TPP-22214. TrkB internalization was assessed by immunofluorescence staining the surface TrkB receptors without permeabilization of the cells followed by confocal microscopy analysis. Data represent the percent of cells with surface TrkB staining intensity above threshold; mean+/−SEM.

Results:

(A) Incubation with BDNF induced TrkB receptor internalization.

(B) TPP-22214 did not induce TrkB receptor internalization.

(C) By increasing concentrations of TPP-22214 BDNF-induced receptor internalization was decrease/abolished.

Example 52

Neuroprotective Efficacy of TPP-22214 and C2 in STZ-Induced Diabetic Rats

FIG. 52

Neuroprotective function of TrkB activation in a rat model of diabetes-induced retinal neurodegeneration using IVT injection of an agonistic TrkB antibody (C2) as well as Doppelmab TPP-22214. Animals were treated with STZ to induce hyperglycemia. The retinal function was assessed by electroretinography (ERG) before and after treatment. Diabetes induction led to delayed implicit times within 3 weeks after STZ treatment. At this point in time, animals were intravitreally dosed with an isotype control antibody (anti-TNP) or C2 (19 µg/5 µl, each), or an equimolar amount of TPP-22214 (25 µg/5 µl). Rod-driven B-wave implicit time delays immediately before and two weeks after intravitreal application of the molecules are depicted; mean+/−SEM; $^{n.s.}p>0.05$; non-significant (n.s.), ****$p<0.0001$; one-way Anova with Tukey multi-comparison test.

Results:

Two weeks after administration, anti-TNP antibody treatment did not reduce the diabetes induced rod driven b-wave implicit time as compared to the point in time before anti-TNP treatment. Indeed, the implicit time delay was even significantly increased as compared to the point in time before anti-TNP antibody application (17.1 ms at t=2 weeks vs. 11.2 ms at t=0 weeks; ****p<0.0001). This indicates that the STZ-induced retinal damage was not fully established at t=0 weeks and that anti-TNP treatment could not stop the further increase in the implicit time delay.

Two weeks after administration, C2 antibody treatment blocked a further increase of the implicit time delay. However, C2 antibody treatment did not significantly reduce the diabetes induced rod driven b-wave implicit time as compared to the point in time before C2 treatment (10.3 ms at t=2 weeks vs. 12.8 ms at t=0 weeks, $^{n.s.}$p>0.05; non-significant).

Two weeks after administration, TPP-22214 antibody treatment blocked a further increase of the implicit time delay and even significantly reduced the diabetes induced rod driven b-wave implicit time by more than 40% as compared to the point in time before TPP-22214 treatment (8.3 ms at t=2 weeks vs. 14.2 ms at t=0 weeks, ****p<0.0001).

Example 53

Comparison of Human VEGF-A Scavenging by Doppelmabs without or with disulfide Bridge (CC) and the Parental Molecules TPP-14940/TPP-14941—Inhibition of VEGF-Induced Phosphorylation of VEGFR2

FIG. 53 A-B

VEGF-A scavenging was assessed by measuring VEGF receptor 2 (VEGFR2) phosphorylation on Y1175. 50 ng/ml human VEGF without molecule treatment served as control. Data represent mean+/−SEM. Below Table 14 reports the corresponding best-fit $IC_{50}$ values (non-linear regression; log(agonist) vs. response (three parameters).

TABLE 14

| TPP | FIG. | Description | Inhibition of VEGF-induced VEGFR2 phosphorylation (IC50, nM) |
|---|---|---|---|
| TPP-14941 | A | (TrkB-C2-VL-VH, __20L3) | 0.225 |
| TPP-22180 | A | (1Q6Q70G__TrkB-C2-VH-VL__10L1) | 0.210 |
| TPP-22204 | A | (1Q6Q70G__TrkB-C2-VH-VL__10L1, CC) | 0.199 |

TABLE 14-continued

| TPP | FIG. | Description | Inhibition of VEGF-induced VEGFR2 phosphorylation (IC50, nM) |
|---|---|---|---|
| TPP-22192 | A | (1Q6Q70G__TrkB-C2-VL-VH__10L1) | 0.264 |
| TPP-22216 | A | (1Q6Q70G__TrkB-C2-VL-VH__10L1, CC) | 0.331 |
| TPP-14940 | B | TrkB-C2-VH-VL, __20L3) | 0.165 |
| TPP-14941 | B | (TrkB-C2-VL-VH, __20L3) | 0.173 |
| TPP-22190 | B | (1Q70G__TrkB-C2-VL-VH__10L1) | 0.235 |
| TPP-22214 | B | (1Q70G__TrkB-C2-VL-VH__10L1, CC) | 0.242 |
| TPP-22191 | B | (6Q70G__TrkB-C2-VL-VH__10L1) | 0.233 |
| TPP-22215 | B | (6Q70G__TrkB-C2-VL-VH__10L1, CC) | 0.195 |

Results:

There was no significant difference between the parental molecules TPP-14940/TPP-14941 and the respective Doppelmab variants with or without disulfide bridge. Potency and efficacy of inhibition of VEGF-induced VEGFR2 phosphorylation was virtually identical.

Example 54

Comparison of Human VEGF-A Scavenging by TPP-22214 or EYLEA® (Aflibercept)—Inhibition of VEGF-Induced Phosphorylation of VEGFR2 on Y1175 and ERK1/2 (Both Related to EC Proliferation)

FIG. 54 A-B

Human retinal microvascular endothelial cells (HRMECs) were starved and then incubated with 50 ng/mL human VEGF with or without pre-incubation with growing concentrations of TPP-22214 or EYLEA® (aflibercept). VEGF-A scavenging was assessed by measuring (A) VEGF receptor 2 (VEGFR2) phosphorylation on Y1175 or (B) ERK1/2 phosphorylation on T202/Y204 (ERK1) and T185/Y187 (ERK2). 50 ng/ml human VEGF without molecule treatment served as control. Data represent mean+/−SEM. Table 15 below reports the corresponding best-fit values form the non-linear regression (log(agonist) vs. response (three parameters). Best-fit values that significantly differ between EYLEA® (aflibercept) and TPP-22214 (P<0.05) are shown in bold face. P-values are also reported in Table 15.

TABLE 15

| | FIG. | Eyela | TPP-22214 | P-value |
|---|---|---|---|---|
| Inhibition of VEGF-induced VEGFR2 phosphorylation (Y1175) | | | | |
| Top plateau (AlphaLISA counts) | A | 17523 | 18104 | 0.4629 |
| $IC_{50}$ (nM) | A | 0.339 | 0.186 | — |
| $LogIC_{50}$ | A | −9.470 | −9.731 | 0.0245 |
| Bottom plateau (AlphaLISA counts) | A | 4031 | −761.9 | <0.0001 |
| Inhibition of VEGF-induced ERK½ phosphorylation (T202/Y204 (ERK1) and T185/Y187 (ERK2) | | | | |
| Top plateau (AlphaLISA counts) | B | 108769 | 111446 | 0.7349 |
| $IC_{50}$ (nM) | B | 1.95 | 0.415 | — |
| $LogIC_{50}$ | B | −8.709 | −9.382 | 0.0087 |
| Bottom plateau (AlphaLISA counts) | B | 21745 | −7737 | 0.0024 |

Results:

Compared to EYLEA® (aflibercept), TPP-22214 fully inhibited VEGF-induced phosphorylation of VEGFR2 on Y1175 and of ERK1/2. The improved efficacy in VEGF-scavenging of TPP-22214 can also be seen on the highly significant differences in the values of the bottom plateaus (see Table 15). Finally, TPP-22214 was significantly more potent in VEGF-scavenging than EYLEA® (aflibercept).

Example 55

Comparison of Human VEGF-A Scavenging by TPP-22204, TPP-22214 or TPP-22216 with EYLEA® (Aflibercept)—Inhibition of VEGF-Induced Proliferation of HRMEC

FIG. 55 A-E

Human retinal microvascular endothelial cells (HRMECs) were starved and then incubated with 10 ng/mL human VEGF with or without pre-incubation with growing concentrations of the indicated binding molecules: (A) TPPP-22204, (B) TPP-22214; (C) TPP-22216 or (D) EYLEA® (aflibercept). VEGF-A scavenging was assessed by automated, image-based quantification of HRMEC cell numbers (IncuCyte). Images were recorded every four hours for a total period of 84 hours. Relative cell numbers are shown. Cell numbers at t=0 were set to one. Non-stimulated cells served as control (Basal). Data represent mean+/−SEM. (E) Plot of the difference of the area under the growth curves and the basal curves vs. the concentration of EYLEA® (aflibercept) or TPP-22214. Below Table 16 reports the corresponding best-fit values form the non-linear regression (log(agonist) vs. response (three parameters). Best-fit values that significantly differ between EYLEA® (aflibercept) and TPP-22214 (P<0.05) are shown in bold face. P-values are also reported in Table 16.

TABLE 16

| Inhibition of VEGF-induced HRMEC proliferation Delta (area under the curve vs. basal) | FIG. | Eyela | TPP-22214 | P-value |
|---|---|---|---|---|
| Top plateau (arbitrary units) | E | 128.9 | 128.3 | 0.9406 |

TABLE 16-continued

| Inhibition of VEGF-induced HRMEC proliferation Delta (area under the curve vs. basal) | FIG. | Eyela | TPP-22214 | P-value |
|---|---|---|---|---|
| $IC_{50}$ (pM) | E | 171 | 88.7 | — |
| $LogIC_{50}$ | E | −9.767 | −10.05 | 0.0093 |
| Bottom plateau (arbitrary units) | E | 13.3 | −14.2 | <0.0001 |

Results:

Potency and efficacy of inhibition of VEGF-induced proliferation by the Doppelmabs was clearly superior to EYLEA® (aflibercept) (highly significant difference in the values of Log $IC_{50}$ and bottom plateau between TPP-22214 and EYLEA® (aflibercept)).

Even at the highest concentration (16 nM), EYLEA® (aflibercept) failed to fully inhibit VEGF-induced sprouting. In contrast all Doppelmabs fully inhibit VEGF-induced proliferation already at a 64-fold lower concentration of 0.25 nM.

Example 56

Comparison of Human VEGF-A Scavenging by TPP-22214 or EYLEA® (Aflibercept)—Inhibition of VEGF-Induced Phosphorylation of VEGFR2 on Y1214 and p38-MAPK

FIG. 56 A-B

Human retinal microvascular endothelial cells (HRMECs) were starved and then incubated with 50 ng/mL human VEGF with or without pre-incubation with growing concentrations of TPP-22214 or EYLEA® (aflibercept). VEGF-A scavenging was assessed by measuring (A) VEGF receptor 2 (VEGFR2) phosphorylation on Y1214 or (B) p38-MAPK phosphorylation on T180/Y182. 50 ng/ml human VEGF without molecule treatment served as control. Data represent mean+/−SEM. Below Table 17 reports the corresponding best-fit values form the non-linear regression (log(agonist) vs. response (three parameters). Best-fit values that significantly differ between EYLEA® (aflibercept) and TPP-22214 (P<0.05) are shown in bold face. P-values are also reported in Table 17.

TABLE 17

| | FIG. | Eyela | TPP-22214 | P-value |
|---|---|---|---|---|
| Inhibition of VEGF-induced VEGFR2 phosphorylation (Y1214) | | | | |
| Top plateau (AlphaLISA counts) | A | 7150 | 7275 | 0.7759 |
| $IC_{50}$ (nM) | A | 0.437 | 0.278 | − |
| $LogIC_{50}$ | A | −9.360 | −9.555 | 0.1991 |
| Bottom plateau (AlphaLISA counts) | A | 1429 | −245.0 | <0.0001 |
| Inhibition of VEGF-induced p38-MAPK phosphorylation (T180/Y182) | | | | |
| Top plateau (AlphaLISA counts) | B | 23071 | 25363 | 0.1608 |
| $IC_{50}$ (nM) | B | 0.748 | 0.472 | − |
| $LogIC_{50}$ | B | −9.126 | −9.326 | 0.4202 |
| Bottom plateau (AlphaLISA counts) | B | 8894 | −1489 | <0.0001 |

Results:

In strong contrast to EYLEA® (aflibercept), TPP-22214 fully inhibited VEGF-induced phosphorylation of VEGFR2 on Y1214 and p38-MAPK. The more efficacious VEGF-scavenging of TPP-22214 can be seen from the highly significant difference in the values of the bottom plateaus in Table 17. Moreover, a trend was observed that the potency of VEGF-scavenging by TPP-22214 is better than that of EYLEA® (aflibercept).

Example 57

Comparison of the Human VEGF-A Scavenging by TPP-22204, TPP-22214, TPP-22215 or TPP-22216 with EYLEA® (Aflibercept)—Inhibition of VEGF-Induced HRMEC Sprouting

FIG. 57 A-B

Spheroids of human retinal microvascular endothelial cells (HRMECs) were embedded in a collagen matrix. Endothelial sprouting was induced for 24 hours by incubation with 50 ng/mL human VEGF with or without pre-incubation with 2.5 nM of TPP-22204, TPP-22214, TPP-22215 or TPP-22216, or 5 nM EYLEA® (aflibercept). (A) Endothelial sprouting was assessed by confocal microscopy and displayed spheroid perimeter obtained from maximum projections of Z-stacks. Non-stimulated cells served as control (Basal). Data represent mean+/−SEM. n.s. p>0.05 non-significant, ****p<0.0001. (B) shows representative maximum projection images from spheroids after 24 hours of sprouting under basal conditions or after stimulation with 50 ng/mL human VEGF with or without pre-incubation with 2.5 nM TPP-22214 or 5 nM EYLEA® (aflibercept). Bar=100 µm.

Results:

Similar to the Y1214 VEGFR2 phosphorylation assays, the Doppelmabs were a lot more efficacious in inhibiting VEGF-induced HRMEC sprouting. Moreover, the Doppelmabs were able to fully inhibit VEGF-induced endothelial cell sprouting. Noteworthy, EYLEA® (aflibercept) was used at the double molecular concentration as compared to the Doppelmabs and still was not able to fully inhibit cell sprouting.

Example 58

Comparison of Human VEGF-A Scavenging by TPP-22214 or EYLEA® (Aflibercept)—Inhibition of VEGF-Induced Phosphorylation of VEGFR2 on Y951 and Src

FIG. 58 A-B

Human retinal microvascular endothelial cells (HRMECs) were starved and then incubated with 50 ng/mL human VEGF with or without pre-incubation with growing concentrations of TPP-22214 or EYLEA® (aflibercept). VEGF-A scavenging was assessed by measuring (A) VEGF receptor 2 (VEGFR2) phosphorylation on Y951 or (B) Src phosphorylation on Y419. 50 ng/ml human VEGF without antibody treatment served as control. Data represent mean+/−SEM. Below Table 18 reports the corresponding best-fit values form the non-linear regression (log(agonist) vs. response (three parameters). Best-fit values that significantly differ between EYLEA® (aflibercept) and TPP-22214 (P<0.05) are shown in bold face. P-values are also reported in Table 18.

TABLE 18

|  | FIG. | Eyela | TPP-22214 | P-value |
|---|---|---|---|---|
| Inhibition of VEGF-induced VEGFR2 phosphorylation (Y951) | | | | |
| Top plateau (AlphaLISA counts) | A | 20491 | 20757 | 0.8567 |
| $IC_{50}$ (nM) | A | 0.540 | 0.340 | — |
| $LogIC_{50}$ | A | −9.268 | −9.469 | 0.2856 |
| Bottom plateau (AlphaLISA counts) | A | 5133 | −743.9 | <0.0001 |
| Inhibition of VEGF-induced Src phosphorylation (Y419) | | | | |
| Top plateau (AlphaLISA counts) | B | 3425 | 3405 | 0.8832 |
| $IC_{50}$ (nM) | B | 0.933 | 0.426 | — |
| $LogIC_{50}$ | B | −9.370 | −9.030 | 0.2219 |
| Bottom plateau (AlphaLISA counts) | B | 2207 | 1629 | <0.0001 |

Results:

In strong contrast to EYLEA® (aflibercept), TPP-22214 fully inhibited VEGF-induced phosphorylation of VEGFR2 on Y951 and of Src on Y419. The more efficacious VEGF-scavenging of TPP-22214 can be seen from the highly significant difference in the values of the bottom plateaus (Table 18).

Example 59

Comparison of the Human VEGF-A Scavenging by Doppelmab TPP-22214 and EYLEA® (Aflibercept)—Inhibition of Human VEGF-A-Induced Retinal Hyperpermeability in Brown Norway Rats

FIG. 59 A-B

TPP-22214 prevented human VEGF-A-induced hyperpermeability in the rat retina. (A) Time protocol showing the experimental procedure. Fifteen minutes after intravitreal (ivt) administration of the anti-VEGF compound (13 or 26 pmol per eye of EYLEA® (aflibercept) or TPP-14940) or the control (26 pmol TPP-11737), 13 pmol human VEGF-A per eye was administered by ivt injection. PBS injection served as control. Twenty-four hours later 1 mL/kg of an Evans Blue (EB) solution (45 mg/mL in 0.9% saline) were administered by intravenous (iv) injection for 30 minutes before the eyes were isolated and fixed. Plasma samples were collected at the same point in time to confirm equal systemic EB exposure. (B) Quantification of VEGF-A-induced hyperpermeability in the retinas of Brown Norway rats was done by measuring EB extravasation in retinal flatmounts by confocal microscopy. Eyes were cut along the Ora serrata, lens and vitreous were removed and the eye cup was fixed in paraformaldehyde (4%) for 1 h at 4° C. and then transferred to PBS overnight at 4° C. The retinae were separated from the outer segments (sclera and choroidea) and transferred to a glass slide and cut four times to achieve a flat cloverleaf-like structure. The tissue was covered with mounting medium (Vectashield® H-1200 containing the DNA stain DAPI) and a coverslip was put on top to obtain a retinal flatmount. The samples were excited at a wavelength of 639 nm and emission of Evans Blue at 669 nm was recorded with a LSM 700 confocal laser scanning-microscope (Carl Zeiss, Jena; gain 800, laser strength 2%, 5 stacks of 60 µm) and images of the retinal flatmounts with maximum intensity projection were obtained. Analysis of fluorescence intensity sum was done after opening the images in the program ImageJ with a threshold of 30. \*\*\*$p<0.001$; \*$p<0.05$; n.s. $p>0.05$. One-way Anova with Tukey multi comparison test, n=9-17. Incubation with 67:1 molar ratio of EYLEA® (aflibercept):VEGF is shown for comparison.

Results:

Under control conditions, intravitreal VEGF-A injection increased the vascular permeability by about 60%. Note: TPP-11737 was used as control molecule because it had the same molecular format (Doppelmab) as TPP-22214 but in earlier in vitro assays did not scavenge VEGF (see above).

At a 1:1 molecular ratio of binding molecule vs VEGF, TPP-22214 completely blocked vascular hyperpermeability. In sharp contrast, however, EYLEA® (aflibercept) failed to significantly reduce vascular leakage under the same conditions and even at the doubled concentration. Only at a very high molecular ratio of 67:1, EYLEA® (aflibercept) was able to inhibit human VEGF-induced vascular leakage.

Example 60

Impact of TrkB-Binding on VEGF-Scavenging by TPP-22214—Comparison of Human VEGF-A Scavenging by TPP-22214 in the Presence or Absence of the TrkB Extracellular Domain

FIG. 60 A-B (A) Functional characterization of the TkrB extracellular domain (TrkB-ECD). CHO cells with stable expression of human TrkB were incubated with growing concentrations of the natural ligand BDNF or 10 nM BDNF with growing concentrations of TrkB-ECD. TrkB activation was assessed by measuring TrkB phosphorylation on Y706/707. The lowest compound concentration was solvent alone. Data represent mean+/−SEM.

(B) Impact of TrkB-ECD binding of TPP-22214 on inhibition of VEGF-induced VEGFR2 phosphorylation. Human retinal microvascular endothelial cells (HRMECs) were starved and then incubated with 50 ng/mL human VEGF, 50 ng/mL human VEGF with growing concentrations of TPP-22214, or 50 ng/mL human VEGF with growing concentrations of TPP-22214 and 100 nM TrkB-ECD. HRMEC incubation with growing concentrations of TrkB-ECD with or without 50 ng/mL VEGF and unstimulated cells (Basal) served as control. VEGF-A scavenging was assessed by measuring VEGF receptor 2 (VEGFR2) phosphorylation on Y1175. Data represent mean+/−SEM.

Results:

Figure (A): The pre-incubation of BDNF with growing concentrations of TrkB-ECD reduced activation of the TrkB receptor dramatically. This showed that the TrkB-ECD is able to bind and scavenge the BDNF, which is expected from a functional TrkB-ECD.

Figure (B): VEGF-scavenging by TPP-22214 was independent of the presence or absence of the TrkB-ECD. Both curves were nearly identical. This indicated that TrkB-binding of TPP-22214 did per se not limit VEGF-scavenging of the Doppelmab suggesting that the Doppelmab can simultaneously activate the TrkB receptor and scavenge VEGF.

Example 61

Engineering Efforts to Improve CMC Properties Series 3 to Series 4

Biophysical properties of molecules from series 3 and series 4 were assessed. During production of the molecules the quality after protein A measured by the percentage of monomer was tested using analytical size exclusion chromatography. Additionally, the thermal stability and aggregation onset of each molecule was assessed in 10 mM Histidine pH 6.0. The thermal stability was measured using a thermal shift assay which measures the unfolding of the protein with temperature using Sypro-orange dye. Each $T_m$ was calculated as the peak maxima of the first derivative of fluorescence signal across temperature. Aggregation onset was measured using dynamic light scattering to measure the hydrodynamic radius as a function of temperature. Finally, the storage stability of various Doppelmabs was tested by measuring aggregation after 2 weeks at either 40° C. or 5° C. Aggregation was measured using analytical size exclusion chromatography.

Molecular modeling was used to identify single point mutations that could potentially raise the pI of the Fv portion of Ranibizumab and therefore potentially improve its solubility, without affecting its conformational stability. This computational design exercise suggested three framework mutations, namely, VH E1→Q, VH E6→Q and VL D70G, where VH and VL refer to the variable portions of the heavy and light chains in Ranibizumab Fv, respectively. The mutations in heavy chain, VH E1→Q and VH E6→Q, correspond to the human germline residues at these positions. The mutation in the light chain VL D70→G is expected to disrupt a solvent exposed negatively charged patch of the Ranibizumab Fv.

The engineering efforts have increased the overall biophysical properties of the Dopplemabs and translated into improved CMC properties for the whole molecule. An increase in percent monomer after protein A was seen for most molecules tested. This improves the overall manufacturability of the molecules. The improvements seen in $T_m1$ and $T_{agg}$ indicate that the engineering improved the conformational and colloidal stability of the molecules. This further translates into a better stability profile both at 40° C. and 5° C.

TABLE 19

|  |  | TPP-19988 TrkB-C2-VL-VH | TPP-22173 TrkB-C2-VL-VH-CC | TPP-22204 1Q6Q70G_TrkB-C2-VH-VL_10L1_CC | TPP-22192 1Q6Q70G_TrkB-C2-VL-VH_10L1 | TPP-22216 1Q6Q70G_TrkB-C2-VL-VH_10L1_CC | TPP-22190 1Q70G_TrkB-C2-VL-VH_10L1 | TPP-22214 1Q70G_TrkB-C2-VL-VH_10L1_CC |
|---|---|---|---|---|---|---|---|---|
| Quality after Protein A | % Monomer | 70.9 | 91.49 | 87.5 | 74.6 | 87.2 | 78.7 | 87.3 |
| Thermal Shift Assay | $T_m1$ (° C.) | 60 | 62.7 | 60.2 | 60.1 | 63.0 | 59.8 | 61.9 |
|  | $T_m2$ (° C.) | 66.7 | 69.7 | 70.8 | 71.4 | 70.1 | 68.3 | 70.8 |
| Aggregation Onset Temperature | $T_{agg}$ (° C.) | 54 | 61 | 58.0 | 53.0 | 62.0 | 53.0 | 60.0 |
| 2 week stability at 50 mg/mL | Δ% Monomer at 40° C. | 9.46 | 0.32 | 0.1 | 6.2 | 0.1 | 1.6 | 0.1 |
|  | Δ% Monomer at 5° C. | 5.08 | 0.12 | 0.0 | 0.6 | 0.1 | 0.8 | 0.1 |

Example 62

Determination of Vitreous Half-Life of TPP-22214

New Zealand white female rabbits received bilateral intravitreal administration of TPP-22214 or Bevacizumab. Vitreous samples were collected at various time points and concentrations for TPP-22214 or Bevacizumab were determined by ELISA. Animals underwent ocular examination prior and at regular intervals following intravitreal administration.

TABLE 20

| Targeting | TrkB & VEGF |  | VEGF |  |  |
|---|---|---|---|---|---|
| Molecule | TPP-22214 | Bevacizumab | Bevacizumab | Ranibizumab | Aflibercept |
| Format | Doppelmab | IgG | IgG | Fab | Fusion protein |
| Molecular weight (kDa) | 202 | 149 | 149 | 48 | 115 |
| Vitreous half-life (days) | 6.7 | 4.3 | 4.3 | 2.9 | 3.9 |
| Publication | Experimentally determined | Experimentally determined | Bakri, S., Ophthalmology 2007, 114 (5): 855-859 | Bakri, S., Ophthalmology 2007, 114 (12): 2179-82 | Park, S., IOVS, 2016, 57 (6), 2613 |

Table 20 shows the results of the experimentally determined vitreous half-life of TPP-22214 and Bevacizumab and compares the inhouse experimentally determined values with the known literature values of Bevacizumab, Ranibizumab and Aflibercept. The reported half-life of Bevacizumab is identical to the in-house/experimentally derived value confirming the accuracy of the applied method and the comparability of the data sets. TPP-22214 was shown to have an in vivo half-life in rabbits which was approximately 50% higher compared to e.g Bevacizumab (6.7 days vs 4.3 days).

TABLE 21

|  | Ocular VEGF (aqueous humor, wet AMD patients) | | | | | | | |
|---|---|---|---|---|---|---|---|---|
| Publication | Hsu, M., Sci Rep 2016, 6: 34631 | | Sato T, Sci Rep 2018; 8: 1098 | | Hata M, IOVS 2017, 58 (1): 292-298 | | Cabral T, Int J Retin Vitr 2017, 3: 6 | |
|  | pg/mL | pM | pg/mL | pM | pg/mL | pM | pg/mL | pM |
| VEGF concentration | 546 | 28 | 228 | 12 | 90.0 | 4.7 | 180 | 9.4 |

Table 21 reports on the literature values of ocular VEGF concentrations in wet age-related macular degeneration (wAMD) patients.

TABLE 22

Dosing interval of TPP-22214
(calculation based on the human $t_{1/2}$ of Bevacizumab)

| Species | Human |
|---|---|
| Eye Volume (mL) | 4.5 |
| Target Dose in 0.05 mL (mg) | 2 |
| Trough concentration (pM) | 400 |
| Number $t_{1/2}$ above trough concentration | 12.4 |
| Bevacizumab human $t_{1/2}$ from literature (days) | 9.7 |
| Days above trough concentration | 121 |
| Dosing interval (month) | 3.95 |

Based on the values shown in Table 21 and just by using the human intravitreal half-life ($t_{1/2}$) of Bevacizumab (9.7 days; Hutton-Smith, L., Mol. Pharmaceutics, 2016, 13, 2941-2950) a conservative estimation of the human dosing frequency of TPP-22214 was calculated (Table 21). At a dose of 2 mg/eye a dosing interval of 4 months is plausible.

Example 63

Comparison of Human TrkB Activation by BDNF, TPP-6830 and the Two Doppelmabs TPP-23457 and TPP-23459
FIG. 61 A-B
CHO cells with stable expression of human TrkB were incubated with growing concentrations of the natural TrkB ligand BDNF, TPP-6830 (a further monoclonal TrkB antibody), or two Doppelmabs TPP-23457 (TPP-6380 as scFv, 10L1, VH-VL; Ranibizumab as Fab) and TPP-23459 (TPP6380 as scFv, 10L1, VL-VH; Ranibizumab as Fab).

The new Doppelmab molecules were now based on a different TrkB binder (TPP-6830) to evaluate whether the observed effects with the Doppelmabs based on the C2 TrkB binder could be also reproduced with a different TrkB binder.

Results:
Again, in strong contrast to TPP-6830 (the original TrkB antibody being a partial TrkB receptor agonists), the two new Doppelmabs TPP-23457 and TPP-23459 Doppelmabs now showed full TrkB receptor agonists activity. TrkB activation by those Doppelmabs was at least as efficacious as the natural ligand BDNF.

This further supports the theory that the sterical formation of the binding molecules may be responsible for the observed increase in efficacy independent of a specific TrkB binder.

Example 64

Comparison of Human TrkB Activation (TrkB Phosphorylation) by TPP-6830 (TrkB Monoclonal Antibody) and the Two Doppelmabs TPP-23457 and TPP-23459 in the Presence or Absence of Human VEGF
FIG. 62 A-C
CHO cells with stable expression of human TrkB were incubated with growing concentrations of Doppelmabs (A) TPP-23457, (B) TPP-23459, or (C) TPP-6830 with or without pre-incubation with 200 ng/mL human VEGF-A (hVEGF). TrkB activation was assessed by measuring TrkB phosphorylation on Y706/707. The lowest compound concentration was solvent alone. Data represent the mean+/−SEM.

Results:
Again, pre-incubation with human VEGF dramatically improved the potency of TrkB phosphorylation (TrkB activation) by TPP-23457 (TPP-6830 as scFv, 10L1, VH-VL; Ranibizumab as Fab) and TPP-23459 (TPP-6380 as scFv, 10L1, VL-VH; Ranibizumab as Fab).

VEGF pre-incubation did not impact on the potency of TrkB phosphorylation (TrkB activation) by TPP-6830 (control).

This further supports the theory that the observed increase in potency is independent of a specific TrkB binder.

Example 65

Comparison of Human TrkB Activation (ERK Phosphorylation) by TPP-6830 (TrkB Monoclonal Antibody) and the Two Doppelmabs TPP-23457 and TPP-23459 in the Presence or Absence of Human VEGF
FIG. 63 A-C
CHO cells with stable expression of human TrkB were incubated with growing concentrations of Doppelmabs (A) TPP-23457, (B) TPP-23459, or (C) TPP-6830 with or without pre-incubation with 200 ng/mL human VEGF-A (hVEGF). TrkB activation was assessed by measuring ERK1/2 phosphorylation on T202/Y204 (ERK1) and T185/Y187 (ERK2), downstream of TrkB. The lowest compound concentration is solvent alone. Data represent the mean+/−SEM.

Results:
Here as well, pre-incubation with human VEGF dramatically improved the potency of ERK1/2 phosphorylation (TrkB activation) by TPP-23457 (TPP-6830 as scFv, 10L1, VH-VL; Ranibizumab as Fab) and TPP-23459 (TPP-6380 as scFv, 10L1, VL-VH; Ranibizumab as Fab).

As shown previously, VEGF pre-incubation did not impact on the potency of ERK1/2 phosphorylation (TrkB activation) by TPP-6830 (control) further supporting the theory that the observed increase in potency is independent of a specific TrkB binder.

Example 66

Impact of TPP-23457 on BDNF-Induced TrkB Activation (TrkB Phosphorylation
FIG. 64 A-B
CHO cells with stable expression of human TrkB receptor were incubated with growing concentrations of (A) C2 antibody or (B) Doppelmab TPP-23457 with or without a constant concentration of 0.3 nM, 1 nM or 3 nM BDNF. Activation of TrkB was assessed by measuring receptor phosphorylation on Y706/707. Data represent the mean+/−SEM.

Results:
In strong contrast to C2, TPP-23457 did not limit BDNF-induced TrkB activation.

Example 67

Impact of TPP-23457 on BDNF-Induced TrkB Activation (Erk Phosphorylation
FIG. 65 A-B
CHO cells with stable expression of human TrkB receptor were incubated with growing concentrations of (A) C2 antibody or (B) Doppelmab TPP-23457 with or without a constant concentration of 0.3 nM, 1 nM or 3 nM BDNF. Activation of TrkB was assessed by measuring ERK1/2 phosphorylation on T202/Y204 (ERK1) and T185/Y187 (ERK2), downstream of TrkB. Data represent the mean+/−SEM.

Results:

In strong contrast to C2, TPP-23457 did not limit BDNF-induced Erk phosphorylation downstream of TrkB.

Example 68

Comparison of Human VEGF-A Scavenging by TPP-22214, TPP-23457, or TPP-23459 Inhibition of VEGF-Induced Phosphorylation of VEGFR2 on Y1175 and ERK1/2 (Both Related to EC Proliferation)

FIG. 66 A-B

Human retinal microvascular endothelial cells (HRMECs) were starved and then incubated with 50 ng/mL human VEGF with or without pre-incubation with growing concentrations of TPP-22214, TPP-23457, or TPP23459. VEGF-A scavenging was assessed by measuring (A) VEGF receptor 2 (VEGFR2) phosphorylation on Y1175 or (B) ERK1/2 phosphorylation on T202/Y204 (ERK1) and T185/Y187 (ERK2). 50 ng/ml human VEGF without molecule treatment served as control. Data represent mean+/−SEM.

Results:

VEGF-scavenging of the Doppelmabs TPP-23457 and TPP-23459 was virtually identical to TPP-22215.

As expected, also Doppelmab(s) based on a different TrkB scFvs binder (TPP-6830 and not C2) did not have any impact the VEGF-scavenging function of the Fabs.

SEQUENCE LISTING (257 sequences)

SEQ ID NO: 1 - protein, 214 aa, Artificial Sequence
  Description of Artificial Sequence: Synthetic polypeptide
DIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2 - protein, 720 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSGGSEGKSSGSGSESKSTGGSDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIK

SEQ ID NO: 3 - protein, 214 aa, Artificial Sequence; identical to SEQ ID NO: 1
  Description of Artificial Sequence: Synthetic polypeptide

SEQ ID NO: 4 - protein, 720 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKGGSEGKSSGSGSESKSTGGSEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 5 - protein, 214 aa, Artificial Sequence; identical to SEQ ID NO: 1
  Description of Artificial Sequence: Synthetic polypeptide

SEQ ID NO: 6 - protein, 719 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSGGSEGKSSGSGSESKSTGGSDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIK

SEQ ID NO: 7 - protein, 214 aa, Artificial Sequence; identical to SEQ ID NO: 1
  Description of Artificial Sequence: Synthetic polypeptide

SEQ ID NO: 8 - protein, 719 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSDIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKGGSEGKSSGSGSESKSTGGSEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 9 - protein, 214 aa, Artificial Sequence; identical to SEQ ID NO: 1
  Description of Artificial Sequence: Synthetic polypeptide

SEQ ID NO: 10 - protein, 722 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSEVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSGGSEGKSSGSGSESKSTGGSDIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIK

SEQ ID NO: 11 - protein, 214 aa, Artificial Sequence; identical to SEQ ID NO: 1
  Description of Artificial Sequence: Synthetic polypeptide

SEQ ID NO: 12 - protein, 722 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSDIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKGGSEGKSSGSGSESKSTGGSEVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSS

SEQ ID NO: 13 - protein, 214 aa, Artificial Sequence; identical to SEQ ID NO: 1
  Description of Artificial Sequence: Synthetic polypeptide

SEQ ID NO: 14 - protein, 720 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKGGSEGKSSGSGSESKSTGGSEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 15 - protein, 214 aa, Artificial Sequence; identical to SEQ ID NO: 1
  Description of Artificial Sequence: Synthetic polypeptide

SEQ ID NO: 16 - protein, 715 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKGGSEGKSSGSGSESKSTGGSEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 17 - protein, 214 aa, Artificial Sequence; identical to SEQ ID NO: 1
  Description of Artificial Sequence: Synthetic polypeptide

SEQ ID NO: 18 - protein, 710 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKGGSEGKSSGSGSESKSTGGSEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 19 - protein, 214 aa, Artificial Sequence; identical to SEQ ID NO: 1
  Description of Artificial Sequence: Synthetic polypeptide

SEQ ID NO: 20 - protein, 706 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGSDIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKGGSEGKSSGSGSESKSTGGSEVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 21 - protein, 214 aa, Artificial Sequence; identical to SEQ ID NO: 1
  Description of Artificial Sequence: Synthetic polypeptide

SEQ ID NO: 22 - protein, 712 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSGGSEGKSSGSGSESKSTGGSDIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIK

SEQ ID NO: 23 - protein, 214 aa, Artificial Sequence; identical to SEQ ID NO: 1
  Description of Artificial Sequence: Synthetic polypeptide

SEQ ID NO: 24 - protein, 722 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSGGSEGKSSGSGSESKSTGGSDIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIK

SEQ ID NO: 25 - protein, 214 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 720 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 27 - protein, 214 aa, Artificial Sequence; identical to SEQ ID NO: 25
  Description of Artificial Sequence: Synthetic polypeptide

SEQ ID NO: 28 - protein, 720 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 29 - protein, 214 aa, Artificial Sequence
  Description of Artificial Sequence: Synthetic polypeptide
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - protein, 722 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 31 - protein, 214 aa, Artificial Sequence; identical to SEQ ID NO: 29
  Description of Artificial Sequence: Synthetic polypeptide

SEQ ID NO: 32 - protein, 722 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 33 - protein, 214 aa, Artificial Sequence; identical to SEQ ID NO: 29
  Description of Artificial Sequence: Synthetic polypeptide

SEQ ID NO: 34 - protein, 712 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 35 - protein, 214 aa, Artificial Sequence; identical to SEQ ID NO: 29
  Description of Artificial Sequence: Synthetic polypeptide

SEQ ID NO: 36 - protein, 722 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 37 - protein, 214 aa, Artificial Sequence; identical to SEQ ID NO: 29
  Description of Artificial Sequence: Synthetic polypeptide

SEQ ID NO: 38 - protein, 712 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 39 - protein, 214 aa, Artificial Sequence; identical to SEQ ID NO: 29
  Description of Artificial Sequence: Synthetic polypeptide

SEQ ID NO: 40 - protein, 722 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 41 - protein, 214 aa, Artificial Sequence; identical to SEQ ID NO: 29
  Description of Artificial Sequence: Synthetic polypeptide

SEQ ID NO: 42 - protein, 712 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 43 - protein, 214 aa, Artificial Sequence; identical to SEQ ID NO: 29
  Description of Artificial Sequence: Synthetic polypeptide

SEQ ID NO: 44 - protein, 722 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 45 - protein, 214 aa, Artificial Sequence; identical to SEQ ID NO: 29
  Description of Artificial Sequence: Synthetic polypeptide

SEQ ID NO: 46 - protein, 712 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 47 - protein, 214 aa, Artificial Sequence; identical to SEQ ID NO: 29
  Description of Artificial Sequence: Synthetic polypeptide

SEQ ID NO: 48 - protein, 722 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 49 - protein, 214 aa, Artificial Sequence; identical to SEQ ID NO: 29
  Description of Artificial Sequence: Synthetic polypeptide

SEQ ID NO: 50 - protein, 712 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 51 - protein, 214 aa, Artificial Sequence; identical to SEQ ID NO: 29
  Description of Artificial Sequence: Synthetic polypeptide

SEQ ID NO: 52 - protein, 712 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 53 - protein, 214 aa, Artificial Sequence
  Description of Artificial Sequence: Synthetic polypeptide
DIQLTQSPSSLSASVGDRVTITCSASQDISNYLNWYQQKPGKAPKVLIYFTSSLHSGVPSRFSGSGSGTGFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 54 - protein, 712 aa, Artificial Sequence; identical to SEQ ID NO: 34
  Description of Artificial Sequence: Synthetic polypeptide

SEQ ID NO: 55 - protein, 214 aa, Artificial Sequence; identical to SEQ ID NO: 53
  Description of Artificial Sequence: Synthetic polypeptide

SEQ ID NO: 56 - protein, 712 aa, Artificial Sequence; identical to SEQ ID NO: 50
  Description of Artificial Sequence: Synthetic polypeptide

SEQ ID NO: 57 - protein, 214 aa, Artificial Sequence; identical to SEQ ID NO: 53
  Description of Artificial Sequence: Synthetic polypeptide

SEQ ID NO: 58 - protein, 712 aa, Artificial Sequence; identical to SEQ ID NO: 52
  Description of Artificial Sequence: Synthetic polypeptide

SEQ ID NO: 59 - protein, 214 aa, Artificial Sequence; identical to SEQ ID NO: 53
  Description of Artificial Sequence: Synthetic polypeptide

SEQ ID NO: 60 - protein, 712 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 61 - protein, 214 aa, Artificial Sequence; identical to SEQ ID NO: 29
  Description of Artificial Sequence: Synthetic polypeptide

SEQ ID NO: 62 - protein, 722 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 63 - protein, 214 aa, Artificial Sequence; identical to SEQ ID NO: 29
  Description of Artificial Sequence: Synthetic polypeptide

SEQ ID NO: 64 - protein, 722 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 65 - protein, 214 aa, Artificial Sequence; identical to SEQ ID NO: 53
  Description of Artificial Sequence: Synthetic polypeptide

SEQ ID NO: 66 - protein, 722 aa, Artificial Sequence; identical to SEQ ID NO: 36
  Description of Artificial Sequence: Synthetic polypeptide

SEQ ID NO: 67 - protein, 214 aa, Artificial Sequence; identical to SEQ ID NO: 53
  Description of Artificial Sequence: Synthetic polypeptide

SEQ ID NO: 68 - protein, 722 aa, Artificial Sequence; identical to SEQ ID NO: 62
  Description of Artificial Sequence: Synthetic polypeptide

SEQ ID NO: 69 - protein, 214 aa, Artificial Sequence; identical to SEQ ID NO: 53
  Description of Artificial Sequence: Synthetic polypeptide

SEQ ID NO: 70 - protein, 722 aa, Artificial Sequence; identical to SEQ ID NO: 64
  Description of Artificial Sequence: Synthetic polypeptide

SEQ ID NO: 71 - protein, 214 aa, Artificial Sequence; identical to SEQ ID NO: 53
  Description of Artificial Sequence: Synthetic polypeptide

SEQ ID NO: 72 - protein, 722 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 73 - protein, 214 aa, Artificial Sequence; identical to SEQ ID NO: 29
  Description of Artificial Sequence: Synthetic polypeptide

SEQ ID NO: 74 - protein, 712 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 75 - protein, 214 aa, Artificial Sequence; identical to SEQ ID NO: 29
  Description of Artificial Sequence: Synthetic polypeptide

SEQ ID NO: 76 - protein, 712 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 77 - protein, 214 aa, Artificial Sequence; identical to SEQ ID NO: 53
  Description of Artificial Sequence: Synthetic polypeptide

SEQ ID NO: 78 - protein, 712 aa, Artificial Sequence; identical to SEQ ID NO: 38
  Description of Artificial Sequence: Synthetic polypeptide

SEQ ID NO: 79 - protein, 214 aa, Artificial Sequence; identical to SEQ ID NO: 53
  Description of Artificial Sequence: Synthetic polypeptide

SEQ ID NO: 80 - protein, 712 aa, Artificial Sequence; identical to SEQ ID NO: 74
  Description of Artificial Sequence: Synthetic polypeptide

SEQ ID NO: 81 - protein, 214 aa, Artificial Sequence; identical to SEQ ID NO: 53
  Description of Artificial Sequence: Synthetic polypeptide

SEQ ID NO: 82 - protein, 712 aa, Artificial Sequence; identical to SEQ ID NO: 76
  Description of Artificial Sequence: Synthetic polypeptide

SEQ ID NO: 83 - protein, 214 aa, Artificial Sequence; identical to SEQ ID NO: 53
  Description of Artificial Sequence: Synthetic polypeptide

SEQ ID NO: 84 - protein, 712 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 85 - protein, 214 aa, Artificial Sequence; identical to SEQ ID NO: 29
  Description of Artificial Sequence: Synthetic polypeptide

SEQ ID NO: 86 - protein, 722 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 87 - protein, 214 aa, Artificial Sequence; identical to SEQ ID NO: 29
  Description of Artificial Sequence: Synthetic polypeptide

SEQ ID NO: 88 - protein, 722 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 89 - protein, 214 aa, Artificial Sequence; identical to SEQ ID NO: 53
  Description of Artificial Sequence: Synthetic polypeptide

SEQ ID NO: 90 - protein, 722 aa, Artificial Sequence; identical to SEQ ID NO: 40
  Description of Artificial Sequence: Synthetic polypeptide

SEQ ID NO: 91 - protein, 214 aa, Artificial Sequence; identical to SEQ ID NO: 53
  Description of Artificial Sequence: Synthetic polypeptide

SEQ ID NO: 92 - protein, 722 aa, Artificial Sequence; identical to SEQ ID NO: 86
  Description of Artificial Sequence: Synthetic polypeptide

SEQ ID NO: 93 - protein, 214 aa, Artificial Sequence; identical to SEQ ID NO: 53
  Description of Artificial Sequence: Synthetic polypeptide

SEQ ID NO: 94 - protein, 722 aa, Artificial Sequence; identical to SEQ ID NO: 88
  Description of Artificial Sequence: Synthetic polypeptide

SEQ ID NO: 95 - protein, 214 aa, Artificial Sequence; identical to SEQ ID NO: 53
  Description of Artificial Sequence: Synthetic polypeptide

SEQ ID NO: 96 - protein, 722 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 97 - protein, 214 aa, Artificial Sequence; identical to SEQ ID NO: 29
  Description of Artificial Sequence: Synthetic polypeptide

SEQ ID NO: 98 - protein, 712 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 99 - protein, 214 aa, Artificial Sequence; identical to SEQ ID NO: 29
  Description of Artificial Sequence: Synthetic polypeptide

SEQ ID NO: 100 - protein, 712 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 101 - protein, 214 aa, Artificial Sequence; identical to SEQ ID NO: 53
  Description of Artificial Sequence: Synthetic polypeptide

SEQ ID NO: 102 - protein, 712 aa, Artificial Sequence; identical to SEQ ID NO: 42
  Description of Artificial Sequence: Synthetic polypeptide

SEQ ID NO: 103 - protein, 214 aa, Artificial Sequence; identical to SEQ ID NO: 53
  Description of Artificial Sequence: Synthetic polypeptide

SEQ ID NO: 104 - protein, 712 aa, Artificial Sequence; identical to SEQ ID NO: 98
  Description of Artificial Sequence: Synthetic polypeptide

SEQ ID NO: 105 - protein, 214 aa, Artificial Sequence; identical to SEQ ID NO: 53
  Description of Artificial Sequence: Synthetic polypeptide

SEQ ID NO: 106 - protein, 712 aa, Artificial Sequence; identical to SEQ ID NO: 100
  Description of Artificial Sequence: Synthetic polypeptide

SEQ ID NO: 107 - protein, 214 aa, Artificial Sequence; identical to SEQ ID NO: 53
  Description of Artificial Sequence: Synthetic polypeptide

SEQ ID NO: 108 - protein, 712 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 109 - protein, 214 aa, Artificial Sequence; identical to SEQ ID NO: 29
  Description of Artificial Sequence: Synthetic polypeptide

SEQ ID NO: 110 - protein, 722 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 111 - protein, 214 aa, Artificial Sequence; identical to SEQ ID NO: 29
  Description of Artificial Sequence: Synthetic polypeptide

SEQ ID NO: 112 - protein, 722 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 113 - protein, 214 aa, Artificial Sequence; identical to SEQ ID NO: 53
  Description of Artificial Sequence: Synthetic polypeptide

SEQ ID NO: 114 - protein, 722 aa, Artificial Sequence; identical to SEQ ID NO: 44
  Description of Artificial Sequence: Synthetic polypeptide

SEQ ID NO: 115 - protein, 214 aa, Artificial Sequence; identical to SEQ ID NO: 53
  Description of Artificial Sequence: Synthetic polypeptide

SEQ ID NO: 116 - protein, 722 aa, Artificial Sequence; identical to SEQ ID NO: 110
  Description of Artificial Sequence: Synthetic polypeptide

SEQ ID NO: 117 - protein, 214 aa, Artificial Sequence; identical to SEQ ID NO: 53
  Description of Artificial Sequence: Synthetic polypeptide

SEQ ID NO: 118 - protein, 722 aa, Artificial Sequence; identical to SEQ ID NO: 112
  Description of Artificial Sequence: Synthetic polypeptide

SEQ ID NO: 119 - protein, 214 aa, Artificial Sequence; identical to SEQ ID NO: 53
  Description of Artificial Sequence: Synthetic polypeptide

SEQ ID NO: 120 - protein, 722 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 121 - protein, 214 aa, Artificial Sequence; identical to SEQ ID NO: 29
  Description of Artificial Sequence: Synthetic polypeptide

SEQ ID NO: 122 - protein, 712 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 123 - protein, 214 aa, Artificial Sequence; identical to SEQ ID NO: 29
  Description of Artificial Sequence: Synthetic polypeptide

SEQ ID NO: 124 - protein, 712 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 125 - protein, 214 aa, Artificial Sequence; identical to SEQ ID NO: 53
  Description of Artificial Sequence: Synthetic polypeptide

SEQ ID NO: 126 - protein, 712 aa, Artificial Sequence; identical to SEQ ID NO: 46
  Description of Artificial Sequence: Synthetic polypeptide

SEQ ID NO: 127 - protein, 214 aa, Artificial Sequence; identical to SEQ ID NO: 53
  Description of Artificial Sequence: Synthetic polypeptide

SEQ ID NO: 128 - protein, 712 aa, Artificial Sequence; identical to SEQ ID NO: 122
  Description of Artificial Sequence: Synthetic polypeptide

SEQ ID NO: 129 - protein, 214 aa, Artificial Sequence; identical to SEQ ID NO: 53
  Description of Artificial Sequence: Synthetic polypeptide

SEQ ID NO: 130 - protein, 712 aa, Artificial Sequence; identical to SEQ ID NO: 124
  Description of Artificial Sequence: Synthetic polypeptide

SEQ ID NO: 131 - protein, 214 aa, Artificial Sequence; identical to SEQ ID NO: 53
  Description of Artificial Sequence: Synthetic polypeptide

SEQ ID NO: 132 - protein, 712 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 133 - protein, 214 aa, Artificial Sequence; identical to SEQ ID NO: 29
  Description of Artificial Sequence: Synthetic polypeptide

SEQ ID NO: 134 - protein, 722 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 135 - protein, 214 aa, Artificial Sequence; identical to SEQ ID NO: 29
  Description of Artificial Sequence: Synthetic polypeptide

SEQ ID NO: 136 - protein, 722 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 137 - protein, 214 aa, Artificial Sequence; identical to SEQ ID NO: 53
  Description of Artificial Sequence: Synthetic polypeptide

SEQ ID NO: 138 - protein, 722 aa, Artificial Sequence; identical to SEQ ID NO: 48
  Description of Artificial Sequence: Synthetic polypeptide

SEQ ID NO: 139 - protein, 214 aa, Artificial Sequence; identical to SEQ ID NO: 53
  Description of Artificial Sequence: Synthetic polypeptide

SEQ ID NO: 140 - protein, 722 aa, Artificial Sequence; identical to SEQ ID NO: 134
  Description of Artificial Sequence: Synthetic polypeptide

SEQ ID NO: 141 - protein, 214 aa, Artificial Sequence; identical to SEQ ID NO: 53
  Description of Artificial Sequence: Synthetic polypeptide

SEQ ID NO: 142 - protein, 722 aa, Artificial Sequence; identical to SEQ ID NO: 136
  Description of Artificial Sequence: Synthetic polypeptide

SEQ ID NO: 143 - protein, 214 aa, Artificial Sequence; identical to SEQ ID NO: 53
  Description of Artificial Sequence: Synthetic polypeptide

SEQ ID NO: 144 - protein, 722 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 145 - protein, 11 aa, Artificial Sequence
  Description of Artificial Sequence: Synthetic peptide
SASQDISNYLN

SEQ ID NO: 146 - protein, 7 aa, Artificial Sequence
  Description of Artificial Sequence: Synthetic peptide
FTSSLHS

SEQ ID NO: 147 - protein, 9 aa, Artificial Sequence
  Description of Artificial Sequence: Synthetic peptide
QQYSTVPWT

SEQ ID NO: 148 - protein, 10 aa, Artificial Sequence
  Description of Artificial Sequence: Synthetic peptide
GYDFTHYGMN

SEQ ID NO: 149 - protein, 17 aa, Artificial Sequence
  Description of Artificial Sequence: Synthetic peptide
WINTYTGEPTYAADFKR

SEQ ID NO: 150 - protein, 14 aa, Artificial Sequence
  Description of Artificial Sequence: Synthetic peptide
YPYYYGTSHWYFDV

SEQ ID NO: 151 - protein, 5 aa, Artificial Sequence
  Description of Artificial Sequence: Synthetic peptide
HYGMN

SEQ ID NO: 152 - protein, 17 aa, Artificial Sequence
  Description of Artificial Sequence: Synthetic peptide
WINTYTGEPTYAADFKR

SEQ ID NO: 153 - protein, 14 aa, Artificial Sequence
  Description of Artificial Sequence: Synthetic peptide
YPYYYGTSHWYFDV

SEQ ID NO: 154 - protein, 7 aa, Artificial Sequence
  Description of Artificial Sequence: Synthetic peptide
GYDFTHY

SEQ ID NO: 155 - protein, 6 aa, Artificial Sequence
  Description of Artificial Sequence: Synthetic peptide
NTYTGE

SEQ ID NO: 156 - protein, 14 aa, Artificial Sequence
  Description of Artificial Sequence: Synthetic peptide
YPYYYGTSHWYFDV

SEQ ID NO: 157 - protein, 11 aa, Artificial Sequence
  Description of Artificial Sequence: Synthetic peptide
RASQVIRRSLA

SEQ ID NO: 158 - protein, 7 aa, Artificial Sequence
  Description of Artificial Sequence: Synthetic peptide
AASNLAS

SEQ ID NO: 159 - protein, 9 aa, Artificial Sequence
  Description of Artificial Sequence: Synthetic peptide
QQSNTSPLT

SEQ ID NO: 160 - protein, 10 aa, Artificial Sequence
  Description of Artificial Sequence: Synthetic peptide
GFTINASWIH

SEQ ID NO: 161 - protein, 17 aa, Artificial Sequence
  Description of Artificial Sequence: Synthetic peptide
AIYPYSGYTNYADSVKG

SEQ ID NO: 162 - protein, 12 aa, Artificial Sequence
  Description of Artificial Sequence: Synthetic peptide
WGHSTSPWAMDY

SEQ ID NO: 163 - protein, 5 aa, Artificial Sequence
  Description of Artificial Sequence: Synthetic peptide
ASWIH

SEQ ID NO: 164 - protein, 17 aa, Artificial Sequence
  Description of Artificial Sequence: Synthetic peptide
AIYPYSGYTNYADSVKG

SEQ ID NO: 165 - protein, 12 aa, Artificial Sequence
  Description of Artificial Sequence: Synthetic peptide
WGHSTSPWAMDY

SEQ ID NO: 166 - protein, 7 aa, Artificial Sequence
  Description of Artificial Sequence: Synthetic peptide
GFTINAS

SEQ ID NO: 167 - protein, 6 aa, Artificial Sequence
  Description of Artificial Sequence: Synthetic peptide
YPYSGY

SEQ ID NO: 168 - protein, 12 aa, Artificial Sequence
  Description of Artificial Sequence: Synthetic peptide
WGHSTSPWAMDY

SEQ ID NO: 169 - protein, 11 aa, Artificial Sequence
  Description of Artificial Sequence: Synthetic peptide
RASQDVSTAVA

SEQ ID NO: 170 - protein, 7 aa, Artificial Sequence
  Description of Artificial Sequence: Synthetic peptide
SASFLYS

SEQ ID NO: 171 - protein, 9 aa, Artificial Sequence
  Description of Artificial Sequence: Synthetic peptide
QQSYTTPPT

SEQ ID NO: 172 - protein, 10 aa, Artificial Sequence
  Description of Artificial Sequence: Synthetic peptide
GFTISDYWIH

SEQ ID NO: 173 - protein, 17 aa, Artificial Sequence
  Description of Artificial Sequence: Synthetic peptide
GITPAGGYTYYADSVKG

SEQ ID NO: 174 - protein, 11 aa, Artificial Sequence
  Description of Artificial Sequence: Synthetic peptide
FVFFLPYAMDY

SEQ ID NO: 175 - protein, 5 aa, Artificial Sequence
  Description of Artificial Sequence: Synthetic peptide
DYWIH

SEQ ID NO: 176 - protein, 17 aa, Artificial Sequence
  Description of Artificial Sequence: Synthetic peptide
GITPAGGYTYYADSVKG

SEQ ID NO: 177 - protein, 11 aa, Artificial Sequence
  Description of Artificial Sequence: Synthetic peptide
FVFFLPYAMDY

SEQ ID NO: 178 - protein, 7 aa, Artificial Sequence
  Description of Artificial Sequence: Synthetic peptide
GFTISDY

SEQ ID NO: 179 - protein, 6 aa, Artificial Sequence
  Description of Artificial Sequence: Synthetic peptide
TPAGGY

SEQ ID NO: 180 - protein, 11 aa, Artificial Sequence
  Description of Artificial Sequence: Synthetic peptide
FVFFLPYAMDY

SEQ ID NO: 181 - protein, 107 aa, Artificial Sequence
  Description of Artificial Sequence: Synthetic polypeptide
DIQMTQSPSSLSASVGDRVTITCRASQVIRRSLAWYQQKPGKAPKLLIYAASNLASGVPSRFSGSGSGTDFTLTISSLQPEDFATYYCQQSNTSPLTFGQGTKVEIK

SEQ ID NO: 182 - protein, 121 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSS

SEQ ID NO: 183 - protein, 107 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIK

SEQ ID NO: 184 - protein, 120 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSS

SEQ ID NO: 185 - protein, 214 aa, Artificial Sequence; identical to SEQ ID NO: 25
  Description of Artificial Sequence: Synthetic polypeptide

SEQ ID NO: 186 - protein, 450 aa, Artificial Sequence
  Description of Artificial Sequence: Synthetic polypeptide
EVQLVESGGGLVQPGGSLRLSCAASGFTINASWIHWVRQAPGKGLEWVGAIYPYSGYTNYADSVKGRFTISADTSKNTAYLQMNSLRAEDTAVYYCARWGHSTSPWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 187 - protein, 214 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 188 - protein, 449 aa, Artificial Sequence
  Description of Artificial Sequence: Synthetic polypeptide
EVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 189 - protein, 107 aa, Artificial Sequence [sequence omitted]

SEQ ID NO: 190 - protein, 123 aa, Artificial Sequence [sequence omitted]

SEQ ID NO: 191 - protein, 123 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSS

SEQ ID NO: 192 - protein, 123 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSS

SEQ ID NO: 193 - protein, 107 aa, Artificial Sequence
  Description of Artificial Sequence: Synthetic polypeptide
DIQLTQSPSSLSASVGDRVTITCSASQDISNYLNWYQQKPGKAPKVLIYFTSSLHSGVPSRFSGSGSGTGFTLTISSLQPEDFATYYCQQYSTVPWTFGQGTKVEIK

SEQ ID NO: 194 - protein, 123 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSS

SEQ ID NO: 195 - protein, 214 aa, Artificial Sequence; identical to SEQ ID NO: 29
  Description of Artificial Sequence: Synthetic polypeptide

SEQ ID NO: 196 - protein, 452 aa, Artificial Sequence
  Description of Artificial Sequence: Synthetic polypeptide
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 197 - protein, 452 aa, Artificial Sequence
  Description of Artificial Sequence: Synthetic polypeptide
QVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 198 - protein, 452 aa, Artificial Sequence
  Description of Artificial Sequence: Synthetic polypeptide
EVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 199 - protein, 214 aa, Artificial Sequence; identical to SEQ ID NO: 53
  Description of Artificial Sequence: Synthetic polypeptide

SEQ ID NO: 200 - protein, 452 aa, Artificial Sequence
  Description of Artificial Sequence: Synthetic polypeptide
QVQLVQSGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 201 - protein, 11 aa, Artificial Sequence
  Description of Artificial Sequence: Synthetic peptide
RTSENVYSNLA

SEQ ID NO: 202 - protein, 7 aa, Artificial Sequence
  Description of Artificial Sequence: Synthetic peptide
AASNLQS

SEQ ID NO: 203 - protein, 9 aa, Artificial Sequence
  Description of Artificial Sequence: Synthetic peptide
QHFWGSPFT

SEQ ID NO: 204 - protein, 10 aa, Artificial Sequence
  Description of Artificial Sequence: Synthetic peptide
GYTFTNYDII

SEQ ID NO: 205 - protein, 17 aa, Artificial Sequence
  Description of Artificial Sequence: Synthetic peptide
YINPYNDGTKYNEKFKG

SEQ ID NO: 206 - protein, 14 aa, Artificial Sequence
  Description of Artificial Sequence: Synthetic peptide
LLKYRRFRYYAIDY

SEQ ID NO: 207 - protein, 5 aa, Artificial Sequence
  Description of Artificial Sequence: Synthetic peptide
NYDII

SEQ ID NO: 208 - protein, 17 aa, Artificial Sequence
  Description of Artificial Sequence: Synthetic peptide
YINPYNDGTKYNEKFKG

SEQ ID NO: 209 - protein, 14 aa, Artificial Sequence
  Description of Artificial Sequence: Synthetic peptide
LLKYRRFRYYAIDY

SEQ ID NO: 210 - protein, 7 aa, Artificial Sequence
  Description of Artificial Sequence: Synthetic peptide
GYTFTNY

SEQ ID NO: 211 - protein, 6 aa, Artificial Sequence
  Description of Artificial Sequence: Synthetic peptide
NPYNDG

SEQ ID NO: 212 - protein, 14 aa, Artificial Sequence
  Description of Artificial Sequence: Synthetic peptide
LLKYRRFRYYAIDY

SEQ ID NO: 213 - protein, 107 aa, Artificial Sequence
  Description of Artificial Sequence: Synthetic polypeptide
DIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 214 - protein, 123 aa, Artificial Sequence
  Description of Artificial Sequence: Synthetic polypeptide
QVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 215 - protein, 107 aa, Artificial Sequence
  Description of Artificial Sequence: Synthetic polypeptide
DIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 216 - protein, 123 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 217 - protein, 6 aa, Artificial Sequence
  Description of Artificial Sequence: Synthetic peptide
GGSGGS

SEQ ID NO: 218 - protein, 10 aa, Artificial Sequence
  Description of Artificial Sequence: Synthetic peptide
GGGGSGGGGS

SEQ ID NO: 219 - protein, 15 aa, Artificial Sequence
  Description of Artificial Sequence: Synthetic peptide
GGGGSGGGGSGGGGS

SEQ ID NO: 220 - protein, 20 aa, Artificial Sequence
  Description of Artificial Sequence: Synthetic peptide
GGGGSGGGGSGGGGSGGGGS

SEQ ID NO: 221 - protein, 20 aa, Artificial Sequence
  Description of Artificial Sequence: Synthetic peptide
GGSEGKSSGSGSESKSTGGS

SEQ ID NO: 222 - protein, 250 aa, Artificial Sequence
  Description of Artificial Sequence: Synthetic polypeptide
DIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIKGGSEGKSSGSGSESKSTGGSQVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSS

SEQ ID NO: 223 - protein, 250 aa, Artificial Sequence
  Description of Artificial Sequence: Synthetic polypeptide
QVQLVQSGAEVKKPGASVKVSCKASGYTFTNYDIIWVRQAPGQCLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGCGTKLEIK

SEQ ID NO: 224 - protein, 250 aa, Artificial Sequence
  Description of Artificial Sequence: Synthetic polypeptide
DIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIKGGSEGKSSGSGSESKSTGGSQVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSS

SEQ ID NO: 225 - protein, 250 aa, Artificial Sequence
  Description of Artificial Sequence: Synthetic polypeptide
QVQLVQSGAEVKKPGASVKVSCKASGYTFTNYDIIWVRQAPGQGLEWMGYINPYNDGTKYNEKFKGRVTMTRDTSTSTVYMELSSLRSEDTAVYYCARLLKYRRFRYYAIDYWGQGTTVTVSSGGSEGKSSGSGSESKSTGGSDIQMTQSPSSLSASVGDRVTITCRTSENVYSNLAWYQQKPGKAPKLLIYAASNLQSGVPSRFSGSGSGTDYTFTISSLQPEDIATYYCQHFWGSPFTFGQGTKLEIK

SEQ ID NO: 226 - protein, 399 aa, Artificial Sequence
  Description of Artificial Sequence: Synthetic polypeptide
CPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREH

SEQ ID NO: 227 - protein, 4 aa, Artificial Sequence
  Description of Artificial Sequence: Synthetic peptide
GGGS

SEQ ID NO: 228 - protein, 17 aa, Artificial Sequence
  Description of Artificial Sequence: Synthetic peptide
KSSQSLLYSSNQKNYLA

SEQ ID NO: 229 - protein, 7 aa, Artificial Sequence
  Description of Artificial Sequence: Synthetic peptide
WASTRES

SEQ ID NO: 230 - protein, 9 aa, Artificial Sequence
  Description of Artificial Sequence: Synthetic peptide
QQYYSYPYT

SEQ ID NO: 231 - protein, 10 aa, Artificial Sequence
  Description of Artificial Sequence: Synthetic peptide
GYTFTGYWMH

SEQ ID NO: 232 - protein, 17 aa, Artificial Sequence
  Description of Artificial Sequence: Synthetic peptide
YINPSTDYTEYNQKFKD

SEQ ID NO: 233 - protein, 6 aa, Artificial Sequence
  Description of Artificial Sequence: Synthetic peptide
SRTGNY

SEQ ID NO: 234 - protein, 5 aa, Artificial Sequence
  Description of Artificial Sequence: Synthetic peptide
GYWMH

SEQ ID NO: 235 - protein, 17 aa, Artificial Sequence
  Description of Artificial Sequence: Synthetic peptide
YINPSTDYTEYNQKFKD

SEQ ID NO: 236 - protein, 6 aa, Artificial Sequence
  Description of Artificial Sequence: Synthetic peptide
SRTGNY

SEQ ID NO: 237 - protein, 7 aa, Artificial Sequence
  Description of Artificial Sequence: Synthetic peptide
GYTFTGY

SEQ ID NO: 238 - protein, 6 aa, Artificial Sequence
  Description of Artificial Sequence: Synthetic peptide
NPSTDY

SEQ ID NO: 239 - protein, 6 aa, Artificial Sequence
  Description of Artificial Sequence: Synthetic peptide
SRTGNY

SEQ ID NO: 240 - protein, 113 aa, Artificial Sequence
  Description of Artificial Sequence: Synthetic polypeptide
DIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 241 - protein, 115 aa, Artificial Sequence
  Description of Artificial Sequence: Synthetic polypeptide
QVQLVQSGAEVKKPGASVKVSCKASGYTFTGYWMHWVRQAPGQGLEWMGYINPSTDYTEYNQKFKDRVTMTRDTSTSTVYMELSSLRSEDTAVYYCARSRTGNYWGQGTLVTVSS

SEQ ID NO: 242 - protein, 113 aa, Artificial Sequence
  Description of Artificial Sequence: Synthetic polypeptide
DIVMTQSPDSLAVSLGERATISCKSSQSLLYSSNQKNYLAWYQQKPGQPPKLLIYWASTRESGVPDRFSGSGSGTDFTLTISSLQAEDVAVYYCQQYYSYPYTFGGGTKLEIK

SEQ ID NO: 243 - protein, 115 aa, Artificial Sequence
  Description of Artificial Sequence: Synthetic polypeptide
QVQLVQSGAEVKKPGASVKVSCKASGYTFTGYWMHWVRQRPGQGLEWIGYINPSTDYTEYNQKFKDRVTLTRDTSTSTVYMELSSLTSEDTAVYYCARSRTGNYWGQGTTVTVSS

SEQ ID NO: 244 - protein, 113 aa, Artificial Sequence; identical to SEQ ID NO: 242
  Description of Artificial Sequence: Synthetic polypeptide

SEQ ID NO: 245 - protein, 115 aa, Artificial Sequence
  Description of Artificial Sequence: Synthetic polypeptide
QVQLVQSGAEVKKPGASVKVSCKASGYTFTGYWMHWVRQRPGQGLEWIGYINPSTDYTEYNQKFKDRVTLTRDTSTSTVYMELSSLRSEDTAVYYCARSRTGNYWGQGTTVTVSS

SEQ ID NO: 246 - protein, 113 aa, Artificial Sequence
  Description of Artificial Sequence: Synthetic polypeptide
DIVMTQSPDSLAVSLGERATINCKSSQSLLYSSNQKNYLAWYQQKPGQPPKLLIYWASTRESGVPDRFSGSGSGTDFTLTISSLQAEDVAVYYCQQYYSYPYTFGGGTKLEIK

SEQ ID NO: 247 - protein, 115 aa, Artificial Sequence; identical to SEQ ID NO: 245
  Description of Artificial Sequence: Synthetic polypeptide

SEQ ID NO: 248 - protein, 113 aa, Artificial Sequence
  Description of Artificial Sequence: Synthetic polypeptide
DIVMTQSPDSLAVSLGERATINCKSSQSLLYSSNQKNYLAWYQQKPGQSPKLLIYWASTRESGVPDRFSGSGSGTDFTLTISSLQAEDVAVYYCQQYYSYPYTFGQGTKLEIK

SEQ ID NO: 249 - protein, 115 aa, Artificial Sequence
  Description of Artificial Sequence: Synthetic polypeptide
QVQLVQSGAEVKKPGASVKVSCKASGYTFTGYWMHWVRQAPGQGLEWIGYINPSTDYTEYNQKFKDRVTMTRDTSTSTVYMELSSLTSEDTAVYYCARSRTGNYWGQGTTVTVSS

SEQ ID NO: 250 - protein, 113 aa, Artificial Sequence; identical to SEQ ID NO: 240
  Description of Artificial Sequence: Synthetic polypeptide

SEQ ID NO: 251 - protein, 115 aa, Artificial Sequence
  Description of Artificial Sequence: Synthetic polypeptide
QVQLVQSGAEVKKPGASVKVSCKASGYTFTGYWMHWVRQRPGQGLEWIGYINPSTDYTEYNQKFKDRVTMTRDTSTSTVYMELSSLRSEDTAVYYCARSRTGNYWGQGTTVTVSS

SEQ ID NO: 252 - protein, 113 aa, Artificial Sequence; identical to SEQ ID NO: 242
  Description of Artificial Sequence: Synthetic polypeptide

SEQ ID NO: 253 - protein, 115 aa, Artificial Sequence
  Description of Artificial Sequence: Synthetic polypeptide
QVQLVQSGAEVKKPGASVKVSCKASGYTFTGYWMHWVRQRPGQGLEWIGYINPSTDYTEYNQKFKDRATLTRDTSTSTVYMELSSLRSEDTAVYYCARSRTGNYWGQGTTVTVSS

SEQ ID NO: 254 - protein, 113 aa, Artificial Sequence
  Description of Artificial Sequence: Synthetic polypeptide
DIVMTQSPDSLAVSLGERATISCKSSQSLLYSSNQKNYLAWYQQKPGQPPKLLIYWASTRESGVPDRFSGSGSGTDFTLTISSLQAEDVAVYYCQQYYSYPYTFGQGTKLEIK

SEQ ID NO: 255 - protein, 115 aa, Artificial Sequence
  Description of Artificial Sequence: Synthetic polypeptide
QVQLVQSGAEVKKPGASVKVSCKASGYTFTGYWMHWVRQAPGQGLEWIGYINPSTDYTEYNQKFKDRVTMTRDTSTSTVYMELSSLRSEDTAVYYCARSRTGNYWGQGTTVTVSS

SEQ ID NO: 256 - protein, 113 aa, Artificial Sequence; identical to SEQ ID NO: 248
  Description of Artificial Sequence: Synthetic polypeptide

SEQ ID NO: 257 - protein, 115 aa, Artificial Sequence; identical to SEQ ID NO: 255
  Description of Artificial Sequence: Synthetic polypeptide

The invention claimed is:

1. One or more isolated nucleic acid molecules encoding a binding molecule comprising: (i) a light chain comprising the amino acid sequence of SEQ ID NO:41 and a heavy chain comprising the amino acid sequence of SEQ ID NO:42, or (ii) a light chain comprising the amino acid sequence of SEQ ID NO:43 and a heavy chain comprising the amino acid sequence of SEQ ID NO:44, or (iii) a light chain comprising the amino acid sequence of SEQ ID NO:45 and a heavy chain comprising the amino acid sequence of SEQ ID NO:46, or (iv) a light chain comprising the amino acid sequence of SEQ ID NO:47 and a heavy chain comprising the amino acid sequence of SEQ ID NO:48, or (v) a light chain comprising the amino acid sequence of SEQ ID NO:49 and a heavy chain comprising the amino acid sequence of SEQ ID NO:50, or (vi) a light chain comprising the amino acid sequence of SEQ ID NO:51 and a heavy chain comprising the amino acid sequence of SEQ ID NO:52, or (vii) a light chain comprising the amino acid sequence of SEQ ID NO:53 and a heavy chain comprising the amino acid sequence of SEQ ID NO:54, or (viii) a light chain comprising the amino acid sequence of SEQ ID NO:55 and a heavy chain comprising the amino acid sequence of SEQ ID NO:56, or (ix) a light chain comprising the amino acid sequence of SEQ ID NO:57 and a heavy chain comprising the amino acid sequence of SEQ ID NO:58, or (x) a light chain comprising the amino acid sequence of SEQ ID NO:59 and a heavy chain comprising the amino acid sequence of SEQ ID NO:60, or (xi) a light chain comprising the amino acid sequence of SEQ ID NO:61 and a heavy chain comprising the amino acid sequence of SEQ ID NO:62, or (xii) a light chain comprising the amino acid sequence of SEQ ID NO:63 and a heavy chain comprising the amino acid sequence of SEQ ID NO:64, or (xiii) a light chain comprising the amino acid sequence of SEQ ID NO:65 and a heavy chain comprising the amino acid sequence of SEQ ID NO:66, or (xiv) a light chain comprising the amino acid sequence of SEQ ID NO:67 and a heavy chain comprising the amino acid sequence of SEQ ID NO:68, or (xv) a light chain comprising the amino acid sequence of SEQ ID NO:69 and a heavy chain comprising the amino acid sequence of SEQ ID NO:70, or (xvi) a light chain comprising the amino acid sequence of SEQ ID NO:71 and a heavy chain comprising the amino acid sequence of SEQ ID NO:72, or (xvii) a light chain comprising the amino acid sequence of SEQ ID NO:73 and a heavy chain comprising the amino acid sequence of SEQ ID NO:74, or (xviii) a light chain comprising the amino acid sequence of SEQ ID NO:75 and a heavy chain comprising the amino acid sequence of SEQ ID NO:76, or (xix) a light chain comprising the amino acid sequence of SEQ ID NO:77 and a heavy chain comprising the amino acid sequence of SEQ ID NO:78, or (xx) a light chain comprising the amino acid sequence of SEQ ID NO:79 and a heavy chain comprising the amino acid sequence of SEQ ID NO:80, or (xxi) a light chain comprising the amino acid sequence of SEQ ID NO:81 and a heavy chain comprising the amino acid sequence of SEQ ID NO:82, or (xxii) a light chain comprising the amino acid sequence of SEQ ID NO:83 and a heavy chain comprising the amino acid sequence of SEQ ID NO:84, or (xxiii) a light chain comprising the amino acid sequence of SEQ ID NO:85 and a heavy chain comprising the amino acid sequence of SEQ ID NO:86, or (xxiv) a light chain comprising the amino acid sequence of SEQ ID NO:87 and a heavy chain comprising the amino acid sequence of SEQ ID NO:88, or (xxv) a light chain comprising the amino acid sequence of SEQ ID NO:89 and a heavy chain comprising the amino acid sequence of SEQ ID NO:90, or (xxvi) a light chain comprising the amino acid sequence of SEQ ID NO:91 and a heavy chain comprising the amino acid sequence of SEQ ID NO:92, or (xxvii) a light chain comprising the amino acid sequence of SEQ ID NO:93 and a heavy chain comprising the amino acid sequence of SEQ ID NO:94, or (xxviii) a light chain comprising the amino acid sequence of SEQ ID NO:95 and a heavy chain comprising the amino acid sequence of SEQ ID NO:96, or (xxix) a light chain comprising the amino acid sequence of SEQ ID NO:97 and a heavy chain comprising the amino acid sequence of SEQ ID NO:98, or (xxx) a light chain comprising the amino acid sequence of SEQ ID NO:99 and a heavy chain comprising the amino acid sequence of SEQ ID NO:100, or (xxxi) a light chain comprising the amino acid sequence of SEQ ID NO:101 and a heavy chain comprising the amino acid sequence of SEQ ID NO:102, or (xxxii) a light chain comprising the amino acid sequence of SEQ ID NO:103 and a heavy chain comprising the amino acid sequence of SEQ ID NO:104, or (xxxiii) a light chain comprising the amino acid sequence of SEQ ID NO:105 and a heavy chain comprising the amino acid sequence of SEQ ID NO:106, or (xxxiv) a light chain comprising the amino acid sequence of SEQ ID NO:107 and a heavy chain comprising the amino acid sequence of SEQ ID NO:108, or (xxxv) a light chain comprising the amino acid sequence of SEQ ID NO:109 and a heavy chain comprising the amino acid sequence of SEQ ID NO:110, or (xxxvi) a light chain comprising the amino acid sequence of SEQ ID NO:111 and a heavy chain comprising the amino acid sequence of SEQ ID NO:112, or (xxxvii) a light chain comprising the amino acid sequence of SEQ ID NO:113 and a heavy chain comprising the amino acid sequence of SEQ ID NO:114, or (xxxviii) a light chain comprising the amino acid sequence of SEQ ID NO:115 and a heavy chain comprising the amino acid sequence of SEQ ID NO:116, or (xxxix) a light chain comprising the amino acid sequence of SEQ ID NO:117 and a heavy chain comprising the amino acid sequence of SEQ ID NO:118, or (xl) a light chain comprising the amino acid sequence of SEQ ID NO:119 and a heavy chain comprising the amino acid sequence of SEQ ID NO:120, or (xli) a light chain comprising the amino acid sequence of SEQ ID NO:121 and a heavy chain comprising the amino acid sequence of SEQ ID NO:122, or (xlii) a light chain comprising the amino acid sequence of SEQ ID NO:123 and a heavy chain comprising the amino acid sequence of SEQ ID NO:124, or (xliii) a light chain comprising the amino acid sequence of SEQ ID NO:125 and a heavy chain comprising the amino acid sequence of SEQ ID NO:126, or (xliv) a light chain comprising the amino acid sequence of SEQ ID NO:127 and a heavy chain comprising the amino acid sequence of SEQ ID NO:128, or (xlv) a light chain comprising the amino acid sequence of SEQ ID NO:129 and a heavy chain comprising the amino acid sequence of SEQ ID NO:130, or (xlvi) a light chain comprising the amino acid sequence of SEQ ID NO:131 and a heavy chain comprising the amino acid sequence of SEQ ID NO:132, or (xlvii) a light chain comprising the amino acid sequence of SEQ ID NO:133 and a heavy chain comprising the amino acid sequence of SEQ ID NO:134, or (xlviii) a light chain comprising the amino acid sequence of SEQ ID NO:135 and a heavy chain comprising the amino acid sequence of SEQ ID NO:136, or (xlix) a light chain comprising the amino acid sequence of SEQ ID NO:137 and a heavy chain comprising the amino acid sequence of SEQ ID NO:138, or (l) a light chain comprising the amino acid sequence of SEQ ID NO:139 and a heavy chain comprising the amino acid sequence of SEQ ID NO:140, or (ii) a light chain comprising the amino acid sequence of SEQ ID NO:141 and a heavy chain comprising the amino acid sequence of SEQ ID NO:142, or (lii) a light chain comprising the amino acid sequence of SEQ ID NO:143 and a heavy chain comprising the amino acid sequence of SEQ ID NO:144.

2. A viral vector comprising the isolated nucleic acid molecule of claim 1.

3. An expression vector comprising a nucleic acid molecule according to claim 1.

4. A host cell transfected with an expression vector of claim 3.

5. A method of manufacturing a binding molecule, comprising
  (a) cultivating a host cell according to claim 4 under conditions allowing expression of the binding molecule;
  (b) recovering the binding molecule; and
  c) further purifying and/or modifying and/or formulating the binding molecule.

6. The one or more isolated nucleic acid molecules of claim 1, wherein the binding molecule comprises: (i) a light chain comprising the amino acid sequence of SEQ ID NO:41 and a heavy chain comprising the amino acid sequence of SEQ ID NO: 42, or (ii) a light chain comprising the amino acid sequence of SEQ ID NO:43 and a heavy chain comprising the amino acid sequence of SEQ ID NO:44, or (iii) a light chain comprising the amino acid sequence of SEQ ID NO:45 and a heavy chain comprising the amino acid sequence of SEQ ID NO:46, or (iv) a light chain comprising the amino acid sequence of SEQ ID NO:47 and a heavy chain comprising the amino acid sequence of SEQ ID NO:48, or (v) a light chain comprising the amino acid sequence of SEQ ID NO:49 and a heavy chain comprising the amino acid sequence of SEQ ID NO:50.

7. The one or more isolated nucleic acid molecules of claim 1, wherein the binding molecule comprises: (vi) a light chain comprising the amino acid sequence of SEQ ID NO:51 and a heavy chain comprising the amino acid sequence of SEQ ID NO: 52, or (vii) a light chain comprising the amino acid sequence of SEQ ID NO:53 and a heavy chain comprising the amino acid sequence of SEQ ID NO:54, or (viii) a light chain comprising the amino acid sequence of SEQ ID NO:55 and a heavy chain comprising the amino acid sequence of SEQ ID NO:56, or (ix) a light chain comprising the amino acid sequence of SEQ ID NO:57 and a heavy chain comprising the amino acid sequence of SEQ ID NO:58, or (x) a light chain comprising the amino acid sequence of SEQ ID NO:59 and a heavy chain comprising the amino acid sequence of SEQ ID NO:60.

8. The one or more isolated nucleic acid molecules of claim 1, wherein the binding molecule comprises: (xi) a light chain comprising the amino acid sequence of SEQ ID NO:61 and a heavy chain comprising the amino acid sequence of SEQ ID NO: 62, or (xii) a light chain comprising the amino acid sequence of SEQ ID NO:63 and a heavy chain comprising the amino acid sequence of SEQ ID NO:64, or (xiii) a light chain comprising the amino acid sequence of SEQ ID NO:65 and a heavy chain comprising the amino acid sequence of SEQ ID NO:66, or (xiv) a light chain comprising the amino acid sequence of SEQ ID NO:67 and a heavy chain comprising the amino acid sequence of SEQ ID NO:68, or (xv) a light chain comprising the amino acid sequence of SEQ ID NO:69 and a heavy chain comprising the amino acid sequence of SEQ ID NO:70.

9. The one or more isolated nucleic acid molecules of claim 1, wherein the binding molecule comprises: (xxi) a light chain comprising the amino acid sequence of SEQ ID NO:81 and a heavy chain comprising the amino acid sequence of SEQ ID NO: 82, or (xxii) a light chain comprising the amino acid sequence of SEQ ID NO:83 and a heavy chain comprising the amino acid sequence of SEQ ID NO:84, or (xxiii) a light chain comprising the amino acid sequence of SEQ ID NO:85 and a heavy chain comprising the amino acid sequence of SEQ ID NO:86, or (xxiv) a light chain comprising the amino acid sequence of SEQ ID NO:87 and a heavy chain comprising the amino acid sequence of SEQ ID NO:88, or (xxv) a light chain comprising the amino acid sequence of SEQ ID NO:89 and a heavy chain comprising the amino acid sequence of SEQ ID NO:90.

10. The one or more isolated nucleic acid molecules of claim 1, wherein the binding molecule comprises: (xxvi) a light chain comprising the amino acid sequence of SEQ ID NO:91 and a heavy chain comprising the amino acid sequence of SEQ ID NO: 92, or (xxvii) a light chain comprising the amino acid sequence of SEQ ID NO: 93 and a heavy chain comprising the amino acid sequence of SEQ ID NO:94, or (xxviii) a light chain comprising the amino acid sequence of SEQ ID NO:95 and a heavy chain comprising the amino acid sequence of SEQ ID NO:96, or (xxix) a light chain comprising the amino acid sequence of SEQ ID NO:97 and a heavy chain comprising the amino acid sequence of SEQ ID NO:98, or (xxx) a light chain comprising the amino acid sequence of SEQ ID NO:99 and a heavy chain comprising the amino acid sequence of SEQ ID NO:100.

11. The one or more isolated nucleic acid molecules of claim 1, wherein the binding molecule comprises: (xxxi) a light chain comprising the amino acid sequence of SEQ ID NO:101 and a heavy chain comprising the amino acid sequence of SEQ ID NO: 102, or (xxxii) a light chain comprising the amino acid sequence of SEQ ID NO: 103 and a heavy chain comprising the amino acid sequence of SEQ ID NO:104, or (xxxiii) a light chain comprising the amino acid sequence of SEQ ID NO:105 and a heavy chain comprising the amino acid sequence of SEQ ID NO:106, or (xxxiv) a light chain comprising the amino acid sequence of SEQ ID NO:107 and a heavy chain comprising the amino acid sequence of SEQ ID NO:108, or (xxxv) a light chain comprising the amino acid sequence of SEQ ID NO:109 and a heavy chain comprising the amino acid sequence of SEQ ID NO:110.

12. The one or more isolated nucleic acid molecules of claim 1, wherein the binding molecule comprises: (xxxvi) a light chain comprising the amino acid sequence of SEQ ID NO:111 and a heavy chain comprising the amino acid sequence of SEQ ID NO:112, or (xxxvii) a light chain comprising the amino acid sequence of SEQ ID NO:113 and a heavy chain comprising the amino acid sequence of SEQ ID NO: 114, or (xxxviii) a light chain comprising the amino acid sequence of SEQ ID NO: 115 and a heavy chain comprising the amino acid sequence of SEQ ID NO:116, or (xxxix) a light chain comprising the amino acid sequence of SEQ ID NO:117 and a heavy chain comprising the amino acid sequence of SEQ ID NO:118, or (xl) a light chain comprising the amino acid sequence of SEQ ID NO:119 and a heavy chain comprising the amino acid sequence of SEQ ID NO:120.

13. The one or more isolated nucleic acid molecules of claim 1, wherein the binding molecule comprises: (xli) a light chain comprising the amino acid sequence of SEQ ID NO:121 and a heavy chain comprising the amino acid sequence of SEQ ID NO: 122, or (xlii) a light chain comprising the amino acid sequence of SEQ ID NO: 123 and a heavy chain comprising the amino acid sequence of SEQ ID NO: 124, or (xliii) a light chain comprising the amino acid sequence of SEQ ID NO:125 and a heavy chain comprising the amino acid sequence of SEQ ID NO:126, or (xliv) a light chain comprising the amino acid sequence of SEQ ID NO:127 and a heavy chain comprising the amino acid sequence of SEQ ID NO:128, or (xlv) a light chain comprising the amino acid sequence of SEQ ID NO:129 and a heavy chain comprising the amino acid sequence of SEQ ID NO:130.

14. The one or more isolated nucleic acid molecules of claim 1, wherein the binding molecule comprises: (xlvi) a light chain comprising the amino acid sequence of SEQ ID NO:131 and a heavy chain comprising the amino acid sequence of SEQ ID NO: 132, or (xlvii) a light chain comprising the amino acid sequence of SEQ ID NO: 133 and a heavy chain comprising the amino acid sequence of SEQ ID NO:134, or (xlviii) a light chain comprising the amino acid sequence of SEQ ID NO:135 and a heavy chain comprising the amino acid sequence of SEQ ID NO:136, or (xlix) a light chain comprising the amino acid sequence of SEQ ID NO:137 and a heavy chain comprising the amino acid sequence of SEQ ID NO:138, or (l) a light chain comprising the amino acid sequence of SEQ ID NO:139 and a heavy chain comprising the amino acid sequence of SEQ ID NO:140.

15. The one or more isolated nucleic acid molecules of claim 1, wherein the binding molecule comprises: (li) a light chain comprising the amino acid sequence of SEQ ID NO: 141 and a heavy chain comprising the amino acid sequence of SEQ ID NO: 142, or (lii) a light chain comprising the amino acid sequence of SEQ ID NO: 143 and a heavy chain comprising the amino acid sequence of SEQ ID NO:144.

* * * * *